United States Patent 10,493,112 (COMPOSITIONS COMPRISING BACTERIAL STRAINS) - sequence listing, part 3

SEQ ID NO: 10 - DNA, 4979951 bp, Parabacteroides distasonis (residues 3,319,969-4,979,951 of 4,979,951)
gacggcatttctttaagttattagcggcgacaggactgatcgcgggagctaataccggaaaagcaaacgctttttcaagcagcgcaaaaggtaaaatcgttattatcggtggaggagccgctggtatcagtatggctgcccgattaaaacattggcttgatgaaccggatatcaccctgattgaccccagcgatcgtcagttttatcaaccgggattcactctgatcgcctcaggtgtataccaaccggaagatgtttggaagaagcaagaggattgtatgcctagcggtataaaatggataaaggactcggtcgctgcggttgatcccgtatggaatcaagtaacgaccaaaagtaacggaaagattccgtacgactttttagtactgaccccgggattacaatgtaactgggaaaaagtagagggcattacccacgacaccttgggacaaggaaacgcaaactctatttacgatttcgaaggagcccaaaagacatggaaagctcttcaagaattcgctaaaaaaggaggcaaaggtatttataccgatacctatacaaaacataaatgtggtggcgctcccaaaaagatctgtttattatccgagcattacgcaaggaaacaagggactcgcgacaaactgcaattgaattattttaccgcatcgaaggagctatacgatattccgtatttcacgcctcgcttgctggaaatatataatgaacgtaacatacctattaacttgaatgtacgtgtaaaaggtgtagacacatccgcaaaacaagtgcattttgagaaaatagagacaaaaggcgaagaaaagatcgtaacgccgttcgtagaggattacgatttcttacacttcaccccgcctatgtccgctcccgatttcgttcgtgatgccggattaggttggacagaaggtaaattggccgcggacgcatgggtaatggtcgataaagagaccttggtacataagaaataccagaacatcgtttctctgggtgatgtagccggtatcccgaccagtaaaacatctgccgctatccgtaagcaagtacctatcgccgccaagaacctgatcgcgctcatggaaggtaaagagccgaccgagaaatacaacggttatgccgcttgcccgatcgttacggattatggacacgtgttgctttgtgagtttgactacgaaaagaaaccagacatttcattcccattctcgatgatcgatacatcaaaagagcaatggcttgcttggatcttaaaggtatatattttaaaaccgatgtatttcaacggaatgcttaacggttacgcataatatgaataaaaaaaatctatgaaataaaactccctataatttcgaatgccaaactacaaagccccgggtttcagttgtacgaaaccggggtttttgatttttaacgggtagccttttccactaaatatacgatcgacttataggatatcccactattcatcgtcaaaccaatctcgcacgtacggctattgctatatccttccgtcgccccatgcaagttcggtttcaagtaatgaagaccggaagcgtttagttccggatagaagaaaccacgatcgcccgcccaaccgcaacaagtaacttgagcgggagagaccacccggttcgcgcataagcccgccagttccaccagcttgtcttgtactcccatcttcgttgtactacaagtagagtgtaccgctaccgtaaccggcaacttagtaaagttcagacgatcacgcataaagtcatagataaactccacaggttcatataatcgtaaacgtttatccaaggtttccctcatatgcagcaagcaagggctcatgtcacacaaaataggcaagcggccgttatcgctcgcccgcaaaagagcctcattcaattcctccgccttctgcgccgcttgcttccggaaccctttactgctaaaagccatgccgcaacaaagcttacttagattctcaggataacgaatcgtaaagtccgctcttgtcaataaagcgattatttgttccgttacacttacaaaatccacatcttcataatcagctgaagctcccatcgtacgggtaatacaagacgggaaataaaccatttccatcccattctctacacccgtcagttccttgaactttgacgcgccagaaggtgtatgccgagtccaaagcgggaatttatgagcggaagccctaaacaagaaagaggcaaatctctcgaatgcgttataccccaccagctttgaaagcacatgaggcagcttaagcaaaggacgaagcatacccgttacggttcccatattcccggcgatgcctgaagcgatagcattcgccaagacaccattctctttccaccgtaactctttgatcaataaaccggtattaatgccaaccggacatgccgtagcacataggccatcggtagcgcaggtagcgttacctttatagttaaaggctttcttgagttctttatatcgcttagagtttgtttccccctgttccgccaaagccgataattccctatagatcacgatacgttgccggggtgtcaatgtcacatgccttgacggacattgtatctcacaaaaaccacactcgatgcatttatcgatcagctcattcgccaacggtatttgctttaagttctttataaacacatccgggtcccgatttaaaaggacgcccggatttaatatattttccgggtcaaagagccttttgatcttccacatcaactcataaatctcctcaccccattcatctttaacaaatggagccatatttcgtcccgtgccatgctccgctttcaagctaccgtcgtagtaaagtaccacatctacaaggctacgcataaaagaagcgtaatgatcgataccttcctgtgcgtttatatccggaaaaatcgtgaaatgaacgtttccatccaataaatgtccccacatcaccgcatttccgtatccataatccgacaagaccccacgcacttgttccaaagcctctcctaaaacctcttcccggaaagcaatatcttcaataatagataccgtcccccgtggccgtcttcccgcagcggaagtaaataaaccgtttcgtacccgccaataagtagcgtaaagcttcggatcggtcgtaaatgataccggacataaggtctgtatatctgctagccgctcctctatatcccggaattggatttgaagttcttcttccgaattagaagacgtgtcgatcagtaacgctaccgcatcctcgggtaaagaatgtaatatctccggcatccccggttcatcctctaccgcatgtaaggcgtttctatccatcaactcggcggcggacaccttgcattggcgtaacgggtctatggctctgcatgcttctatcaaagaggggaaataaatcaaggcggaagcttttaaagactcatccgggactgtctcgaaagtaaccgaagaaataaaccctaaggttccttccgagccaaccattaaatgcatgagtatatcgtatggatcagtataatccaagaaagagttcattccataaccgcaggtattcttcaactcatatttagatagaatccggtcttccatgtccggattcaacaagatctccaaacggaaattcatcaacttttccaataagcctatatgcgtttgcatgaaatccctgcgactcgctaacgaagaagtatccaaaaaggctccatccgcgaagataatttccatatcccgaatcgtattatacgagttatggataataccatagctagaaccactcgagttattcgctacgatcccacctatacgtgcggatttgatggaggcagggctaggacccagtttgcggccataaggcctcagccaccggttcgcctcttctccagttataccacaggggaatttagctaaactcccatctcctgaaatcttaacctttccataatcaggactgatttccatcaatacagaatctgtgatagtctggccggataaagaagtccccccagctttaaaggttacagatttaccagtcttctcacattcagcaagaacacgttttacatcctgctcacaactcacgatttcaactcgtttgggattcaacctgtaaatcccggcatctgttcccttcgctaatgtagttaaagcatcagcatataccttttttatcttcatagtctaatacctttatttgtctagaaacgacatttcaacaaagatatgaaacctttaagacaatcagggcatttctctaaaataacgaggagaatacccgaatactagctccggatggaaaatccagattaaatctttcaatagatattccggatgtatagggaattcctcgtaataaggaactgcacctgtattacaggtataaatccgtttttttttaaaagcgtcgaaattctcgtaaggagtatattcggagcgtaaatctttataggtcatctcagaagactgattatatttaacaagccaaatatccgcatggatcgctttatcaaacacggtctcaaatgctaagggggtacttccggcacccggtaaatccttaaacatataatcggctccggcgtcctcgataagatgagccatataactatctccggatggtacataccacgaagagccgaacttcttctccgacaaaacagtaggacgattatctatatttgcggttaagtcctttagagacaaataggcttgctctgtttctttaaatatagaatcggccatctcttcctttccgaatagcaaaccataaaagcgaatccactccgtgcgccccaaaggaaatgcctccatatagtcggctccttcgataatgggtatccctatcttctcgacaggcccataactactgttctgaaacggggaagctatcacgagttccgcaccgatctctatcattttctctatattcggagaggtagcctcacctaaatcagcgattcttccggcctgtataccctcttgtatggcaggagtatccatataacgaggctcacaaacacctataaccttattgatttcgtgcaattgatcaataatagccgcatgaacagaagtataaaccacaatatcttttaccgggaccttcacgatcgtccctttgggtaatccgccaggaaccgactttgtccggtctaccaataaatagcgttgaagcagacgagtactatcccacggatcacgaacttccaccattgtataggtatcaaagcgctgaaccgtgaaaccttgggcatattgaatactatcagaggaaagagcttccttggaagaagtttgctttccggatggcgtacatgccaccatccagaaagcgaaccctaagagaatcagtaatcgcattagatattatctttttgagcgaggactactttcatgggatttaaaccggcctcaaacttcttgaacaatttaccgtcacctccgaaacaataaatatcgccattattcttataatcagactctgcgacatagacatttccacccacggcactgattgaataaggggactgtattgaggttccatctgtaataaagctcgttcccgcagattgactctttgtatcaaatgttaaaaatgcagggctagacattccccattgcgcatagaacagaaatagcttgccatcctcataggccatctccgttgcgtttggacaattcgtaagggaagtaacctcataagtctccgtatttatcttttgtaccgtattgggtatatccgcatagttacccatagaaaccacatatacatttccttgctcatccgcctgtatccgtgtgggattcaatactacatccaacttctttatctctgtaaaagtagacagatcaaccactgataccgttttatcatacccaacctcggtactgtaatccatacctccggagtttgagacaaacaatttattagaagataccgccaattgttccggattccgtccgacctttaccttcgcctcaacctccaaggatgcggtatccaaacgagcgacatatccattataatagctaatatagacttttccaccctctgataccatataacggggctgcccctctgtcttgacttgcttaatggattttgccttcagatctgtcacttctatcgtagactctccatataccgcgatatacatcttatcgccatacacgatcatatcctgtgccgtatctcccagccccctgccattttgagccaagaaataatcggggacaacctcatccttttctatgtcgtacatatataaagaagagttgttatttcccatattgcccgaattcaagaaatataaagccatgaaagaactatccttcacaaaatcaataactcttacggaagcataaacagaagactcaccttccgcatttgcggctataactaataaatagcctatatttacgacatccgtaatagcatatgaatgtgttccaacttctacctccgcaattttcatatctttagcggttccatcagaggaaccataaatcacgtactttgttacattgtcaacagaagacggagctgtccaatttaaggttccgctaacttttaaagcttccggattctcatccgtaaaactgacattagttacagatacatttggtatgttcagtgaaggctcattgtcatcatcacagctgacaaacgagaaagacatcaatgcacacaaggcagagacacaaactaaattcttctttttcattactttacttttatagtttactaataggataaacaaatacttaaacgccaagaacggcccggcatgggataatactgaataacatcataattcacgttcgcaagatttaacaattcaccttgcaaacgcaaaccgaaatatcgaaaacgaaaatctcgatttatagaaatactctgttctatataagaatcaatcctgttccgatctatattttgcggcaatgcataacgatcaccaaccgcagtcagtatataagagacatttacccatggattttccaaggttacggaaaccgtgccagaatgacgaggtgtataaggaatctgatccttataattcttagcttccggatctgtcacatcaaccgcgtattgaaaagaataagtggaagccaaaagcaagctcattcgtaagggcaatcggaattgtgtagataaatttacatctacccctttaatatccacttcgcccatattcatcatcttccaaacatacatggtaggtaaagccacgatcttatctttcaccgtattataatatccatccgccgaaatactgaaatgccgcagccaatccccacaggaagaactccatgttacccctacattatattgggaagtttcttccggtttcaaatttgtatttcccatacggaggtaatacaagtccgtaaatgtaggaacccggaatatatctttgtaagaggcacgtatccgcaaagtactttccgagaatggccgccaagacaaacttacagccggggataaacgcctcttatcatccggtttttccccttgctccactttatcagtgatatatgttcccaataaactagcggtagccgtgaatcgactgttcttatattgcaccgctagtactgattgagaggccattcgctttggattagggccgttcacaaaattattgtccagcatagagcgagttaaatccgtagtcaacgtcgccgatacatactttataggagtatacagcaaacctacagagccataatactcattctgtgtattcaaatcgacttgttcgcccgcagcatatttatcatttatatctaaataacgagtaaaagcataattatacttagccatggcccgtagcgtaaatttctcattaagaacattcttataccccgattgcacgaaaaagttattatcccataatcgttcagaagtgttcttgttatataaattaacagaaccgggaagcccccgctccgaatcaaaatagtacgccttaaaggaaagttcgcctccccttccaaaatcgccgaatagattaccttccaaatggtaagcatggatatcgctatttctacgcttctctctcgtctccaattccccattaatcaatgtatagggatattgcccatccgcacgcacgaaatcaccatgtaaggatgcgctccaacgctttcctaatttttgatcataatgcagcacgggattaaaaagcccgaaggaacctcccttaaccttaagataagtatgaaacgatttgtctttaaacgtgggctttccggtttgtatattcaaggctcctgccgaggcatacacccttgccgtttggaagatgtcatccgattgtccgatcgataaggaaaccatctccacgttatccaacgagaaacggctgatatcgacttgcccgctttgcgcatccgtaatcgtcaccccatcgtaactgacggcggtatgcttcgctcccaagctacgtaccgagaccgttttcaatcctccgatcccccataatcctgtactgtaactcccgagaagcgtttcacggcctcggataggtcttgtactcccaagcgatcgattcccgcccggtccataatttgcaaaggcgtaccttcacgggtgaccgacggacgtaccttctccactacttccaccccggaaagctcgtgataggccgtcgtatcgatctgttgaccgaaagcgacacccaaagaaaataaccatacgctaaaaacgcacagacatcttataagatataaatctcgcataataattcttaggtttaccaacgtcttcacccgaaacgtcgcataacaaaatcatggcaggttttctggctcgtccaccctctgtcggctaccttcccgcctatccgataggcagtggcaacaagatttgccggggctccaaggacttacagctacgggtacagctccggactcgcaccggattcccttttactgattattatcggaatcgataacatctacaccttgattggccgcaaagatacatgtttactttttgattagcaacaaaaaagccccccggcgaatcacttcggcggaaggctagggagtttacacttttctaaacattactaacaacaaaatatttattctatgtataaaagaataatatcattaactgtgcggtcaacacacgcaaaaacatggtcaatggataaaccgtcgcatatccaaccgccggcgcatcatttcctgccgccatattggaataggctaacgcaggaggatcggtcgtacttcccgcaatcaatcccatcaacgtaaaataattcagtttataaaaataccttcccacacaaccgataatcagtagaggcaataacgttattataaaaccataaccgatccaagctacaccacccttattgactatcgtatcgacaaaaccttcacccgcactcaatcccacgcaggcgagaaacaacgtgattcctaattccctcaatagtaaattagaactttgcgtggtataagtaaccaatttataacgataaccgaaccggcttatcaatatcgcaacgatcaacggacctcccgctaatcctaatttcaccggttgaggaatacccggaaaactaataggaagacttcccacgataatacccaaaactataccaacaaaaatagtcaccaaattaggttcattcaagcgtttcattgaattacccagcgtctcggcaactttctccaccgccaattcactaccgaccactgtcacccggtcgcctatttgcaagaccagattaggagtagctaccaactccagccccgcacgattgatccgagtcacgttaattccatgtaaacggcgtaactgcaaagcccctaattgcttaccgttgatttcagaccgggtaaccaaaatacgccggctgataaactggctttccgccggaatccattgcttacgatccatctgtatttcttgaccgataaaagtctttatcgcctccacgtcatgctctgcggtaataacaaaaatcttatcatccccattcaataccgtgttccccgccacgatctctatccgattcgtatcgttacgtaaaatacgggaaataacaaattcacggtgttccaacaatttagatagctcacttacgctacgaccaaaaatcgccggattcttcaccaccaaagagataggtacagcctctcctcccgattccgtatccgtctcttcttccaattgttccgtctccttcgcaaaagagatacggaaaacataacggataaaaatcatcgacaagataatgccgatcacacctaacggataggcaaccgcatatcctaaagcgatcgtttcatccgagatccccgtcatatctgaataagcctgttgagcagcgcccaatcccggtgtattcgtcactgctccggataagatacctaccattgtcggtataggaatgcctgtaatataatgtataatcaaggcagtaatcacccctagaaaaacaataccgcaagcaagcatattcaacgtgatccctccctttcgaaacgaagagaaaaatccggggcctacttgcatacctaccgagtaaacaaataagatcaaaccaaactctctaaaaaaatgaacgaccgacggattcgccgtaaaaccgaaatgcccgagaaagatcccgacaaacagtaccatggtaatccctaaagagataccgaatagcttcagtttaccaagctggatccccagagcgatcacaacggataacaaaaggatagaatgccctaccccttctccccataacaattcattaatccattccatatctattcatgtatatattaatttaagataaaaaagtacctctggcgaatcacttcggcagagatacacatattgaacatttagtatcccagtttaatctggcatccattctaacaacatttactaatatattttctatttcttatgctgataatttagacaaactttcctcttccggcaaaagggttaccggccattcaaatgtcgcacgacagtgcgaacagatccttttcatacgtctttgttccttttaagatattgcttatcttttcgtactgctttcctaatccctcgagcaaaaacagcctttaatgaatggcaggtcttctgactgactcccatcttgaagccttcccggtcgctagaaccagtggcgatagtgttgtttcaagatgttcttcggagcttcacagcagcgggactgtccgggatttacacccgattcccttttaatccacatacccgaatggtatatgcggaaccgattcgggaacaaagatagcatgttttccgtatatatcatatcttttcgcttttttgtttacttttattatccaaataaaaaaatcccgggacaaaacaattgaaccgggatcttttaacctctaagctatcctcccgacaggaagaggctttgattttccttaaataataattactacaagggaatatttccatgttttttaggaggattactctggctcttatttttcgccatttccaacgcctgaatcaatttaaaacgtgtgtctctaggttgtatgacttcatctataaatccttgctcggctgcccggtaaggatttgagaatttctcggtgtattcacgaattgcttgtttcttctcctcatcgttggctttccggtataatatattcacggcaccttcagcccccatcaccgcaatctcagccatcggatatgccaagtttatatcggcaccggtaggcttacttgccattacgatataggctcccccgtaagccttccgggtaatcaacgtgattttgggaaccgtggcctccgcataagcgtagacaatttttgccccgtggcgtataattcccgcatgttcttgcgtacagcccggcaagaagcccggcacatcctcgaacgtgatcaatggaatattgaagcaatcgcagaagcgaatgaaacgtgcggccttatcagaagcatcgatatccaagactcccgctaaaaaggcaggttggttccctacgatacctatggtacggcctcccaaacgagcgaatcccactacaatattgcgagcgaaatgaggcataatctcgaaaaagtaatgattatccactatcggctctataatatccttgatgtcataagggacattaggatcttccggaatcacatgctgcaacgactcttctacccgacgcacatcgtcagcacaagctataactggagcgtcttccatattattagaaggcaggaaactcagaagttcccggatactcatcaaagtctcctcttccgtatcacacacaaaatgtgcgaccccgctttttccgctatgtacctgcgccccgcccagctcttccttatcgatcacctcgtgagtcaccgcctttacgacatccggccccgtgataaacatatgactttgctctttgaccataaaaataaaatcggtcaaagccggggaataacaagcgccccccgcacaaggccccaaaatagccgataattggggaacgactcccgaggccatcgtattttggtaaaagatagaagcataaccagccaagctattcaccccttcttgaatccgggcaccccccgagtcattcaaggcgatgatcggcgctccgttctttaaggctaattgttgcactttcacgatcttagcggcattcgtggcactcaaggtcccaccgtatgcggtaaaatcataagcgtaaacaaataccaaacgaccatcgatctttccataaccacttaccattccatcaccgggaatcttattcttatccatcccgaagtttgtacaccgatgcaccacgaatttatccagctcattgaaagtccctttatccaacagcatctcgattcgttcacgggcggtcatacgcccgcaagcatgttgtttctcaatgcgattcaatcctcctcccaacgaggcctctttattcaaagcctcaaaatctttatataattgctcgttattcatatgaatcatcttttaataggtctaaagtcataagcacttgattgttatcaacggaatctccctcggataccaatatatcttttaccacgcatgctgagcttaccttatagttactctgcatcttcatcgcctcaagtacgaccacggtatcccccgtttccaagcgatctcctttccgcacaggtattttcacgactttacccggcatcggggcgacaatcttgtcatcttgcttctcttccgcacttttacgcatacgcaaatatttcttttgggtatctacgatatccacatgataggaacggtagaacatattcacgtcataactccgatgatcttctccggagatgatctccgcgttaaatgagttcccatcgtgcaagacagaacaactgccgttctccgtcatcacgatatccacatcatacggcttcccgtcgatagaaagccggactttattcccttctttactgaccaatgtcacatcggccacacgatttccgatatgtatttccataaccaatacccgttaaatccgtaagacacctttttgtaaaccaaactcccgccaacggctgataggacgtgtatccaccaattgggtagaagtattttcctctaaattcatcaaataatccatataagcggcgatcatggcgatattctcgatttcctcgttattaccgttagaccgttgtagcatccgggcattcttagcgataaataatgtattatattcccctttcacgaaatcaggattatgcatgatacgtttcaaataactgaggttcgtctttaagcccgtgattttatattcatatagaacccggcgcatacgctcgatcgcatacgcacgtgtcgttgcccatacgattaatttaccgatcatagggtcataatagaccggaatctcatacccttcatatacatagctatcgatacgtaccccgataccattcggttccgttaattgccggataatacccggggaaggcatgaaattattttccgtatcctccgcacagatccggcactcgatggcatgtcctcgttggaaaagatcttcttgacgaagatgcaaaacctcattattggcgatacggatttgttcctttaccaaatccacccctaccacttcttccgtgataggatgctctacttgtagccgggtattcatttccaaaaaataaaaatggcggtccttatctacaaggaactctatcgttcccgctccggaataatgaaccgctttagccgcagccacagccttttcccccatttctttacgtaagtccgctgttaggaatggagacgggctttcctctactattttctggttacgacgttgaaccgaacattcccggtcaaatagatgaatgacattaccatggttatctcccaatatctggaattctatatgatgcggctcctctacgaatttctctatatataccgtatcatcaccaaatgaggacaacgattctgaacgagccgtatgataagcctcgacaacctcgcccttctcatgtatcaggcgcatcccttttcctccacctcccatagaagctttcagcataacagggaaaccaatttcttcgcaaacccgaagcgcttcttccgcactttgcaacggttgctccgtaccgggaaccacaggaacctctgcggcgatcatgcgtttgcgtgcggcgatcttatctcccatcgcttccatcgtctccgctgacgggccgataaatatcaatccttcttgcttacaacggcgtgcgaagtccgcgttctccgacaagaaaccataaccgggatgtatcgcatcggcatggtgccgtttcgccgcagcgatcagattgtctatattcaaataactttccttggaagccgccgggcctatcaaggctgcctcatccgcatacattacatgccgagcggtacgatcggtctccgaatatacggcaacagtgcgaatccccatctccttacatgagcgcatcacacggatagcgatctcacctcgattcgcaacaagcactttacggatcatgtcgccacgaggacataaattctccataaatcattaactattgattcttattcttttcgtactgctttcctaatccctcgagcaaaaacagcctttaatgaatggcaggtcttctgactgactcccatcttgaggccttcccggtcgctagaaccagtggcgatagtgttgtttcaagatgttcttcggagcttcacagcagcgggactgtccgggattcacacccgattcccttttaatccacatacccgaatggtatatgcggaaccgattcgggggcaaagatagtattttttatttaactatccacttcagccaggccggaatatacggaatacacggatcccaagtaaaattccgtacaataagctcacaagagaagcttatgcataaagcattaaaaatcaacattaaaaaaacaggataatctttctgcgaaaacacatacatgtttttgaaaaaagtcgtacgtgttttctggaaaggtcgtacgtgttttcctgaatccttccaccgaaaacaatagcgcatgctaaaatttacaagaagctccacttaaatgagatgttaaatgaaaaagccttactttttgtagagtcaacaggcaagtacagtttttatacatttcgtttgttcgtgttctcagctattttgtgtaactttgcgtatgcttgaaggcatatcaatttgaagctgcctattcttgcttgcgttaccttgtcgtaataattggctcaaataaagaataagactctacaatgagatgaattgaacacatgaaaactgaatatcaaaaatgtatggatgaggagcctttcgacggctcatcgcccgaaataacggaaatgactgtccgtaacaaaaggctactacaccaactcagagaaacggattatgccgacaatgaggcaaagcagcgcatctatcggcagatgttcggaagtatcggcaaggatgtttacatcgacatagacttccgatgcgagtatgggaaaaacatctatttcgggaacaaggtgatcgtgaacatgaactgtacgttcctcgataataacaatatcattatcggtaacaacgtgatgatagcccccgatgtgaaaatatataccgcaactcattccgttcaccttgcggaaaggatgccggaaaggacacatcccggagcgtccatctgcgacacaattgcccgacctgtccttatagaaaatggtgtatggataggaggcggctctacaatccttccgggtgtgaccatcggtaaaaactctgtcatcggagcaggcagtgttgtcgtgaaagatattcctgccaattccatagctgtcggcaatccttgccgtgtaattaaaaatatcgaagataatgattaaaaacctcatttttgattttggcaaggtcctcgtaaatcacgatttgcaacccttgcttgaacgacatttcggggatgatgaagtgtcactaatcggttttcacaaaattctatcagatccgaaatttataaacatgtgcgaccgtggaataatcccgtttgataaaatgattgacggagcgataaaaaggtatcctgaatatagtgatgccttcacgtttttcaaagataattatctagaagagataacaggagagattgaaggtatgcgtgtacttctaaaaaagttaaagcaatctggattcaaactatatgggttgacgaactggagcgacacaatctaccgggtcatggagaaattcgacatattccggttacttgacggtatggtaatatcatgtgaggaacacttcatcaagccagaaaaggaaatttatcttcgccttcgtgacaaatatggccttaaaccgtcggaatgtttgtttacggatgacagaatggtgaatgtgttgggtgcaaaggcgattggaatggaagctgtattgttcacaacacccaaagaatatatttttgaaatagagcgaatttgcggtatcaaaattgaacaatgatgaataccagaaattgcaacagccggagatgcgtttagagaatagcgaatatcgcaccattgattaacgacaaataaaacaaagaagaatatgggtatcggaaaatggataggcggtgtcttggggtttatggcattcggaccactgggcgctttagccggtattatattaggctctttctttgaggaagaggcaaacatgacgggacagcccttcggtggcagaaccaattacgatgatcaatatacacgaagagacccatacgccggggagcgtaacagtttccttttctccatgttggtaatggcctcctatatcatccgtgccgatgggaaaatcatgcacagcgagatggaatatgtccgtcaattcctccgaaggaacttcggcgagatcgccgtaggccaaggtgaagagatattgctaaagcttttcgaccaagccaaacgcatggagcaagagaatagcataggattcaagaataccatccgggaatgcggaacccagatcgcatacaacctaagttatgaggagcggctgcaactgctggcgttcctcgccgagatcgctaagagcgacggtaatgtttgcgccaccgagatcaacgctttaaaagaggtagccatagcgatgggaatgtctgaaaaggaagttgaatccatgttaaatcttcaggaaaactccctagataacgcctataaagtattagagatagaacccacggctacggacgatgaggtgcgtgccgcttaccgccgcatggctatcaaacatcatccggacaaagtagccaaccttggtgaagatatccgcaaggccgccaatgagaaactccaaaagatcaatgaggctaaggagcgtatctataaagcgagaggcatgaagtaaataagaaaatggaaatattttctcaatgtctgtattatttaattaaaaagacctacctttgcccacgattttagtaaccaagctatcacatagtttggtgagagggaatccggtgtgaatccggagctgttcctgcagctgtaatcctcattaagttggttagaagttcaaaagccactgttcttgaattggaatgggaaggtttctaaccagaggagagccagaatacctgctaaagtcttacaataacatcaagcttccaggatagaagtatgtgtcatacaaaaaacgattcaatttattttttgagacataaccagatagaggcttgttgttttatttcgtgtataaataaaacactatatgaggcttttagcattcgctattctggtggcatgcgtacaatccgtatgcgcccaaagcatattgaaagatccgaaggaactttccgtgctattgaacgaggtcgtggtcaccggtacgggtaccgaacactatctgaaagacgcccctgtgcaaacagaggtaatcaccggcaaagcccttgacagttaccaaggacgtagtatgcaagatattctggaagggctgaacgcttccatcaccttcaatccgagcgacatgggtagtggcatccagatgaacggattaggcaacgattacatcttgatccttatcaatggcaaacggatcaacggagataccggcggacaaaacgacttgagtattatcaaccccgccaatatcgaacgtatcgagatcgtaaaaggtgccgcctcttccctgtatggctcggacgctatcgccggtgtcatcaatattatcacgaaaaagaaccgggataaagtgagcctatcgaatacgactcgtgtcggatcatatggagatatattggaaagcgtacaaatcggctttgggcataagagagtgaattccaacacctcacttagtacgacccatacggacggctggcgaaatacgacccaagaatgggaccatcacgaggtaatgaatggaaccgtgacacgaaccgtaaaccgatccacgaactttacgttaagggagaacttaacctacaaagtgaacgaccggctgagcctttcggccgatggctctttttaccagaaatggaattatcgtccgcacggcgcattcaagtattatacctatgatcaattctaccggaacttcgatgtagccggaggagctaaatacgcattgggagggcagaacttcctttcggtagatctaacgtatggtaactatagctatttctataattaccatcataaagatgtcacgaacttcttcgatccgaagacggatttacgtatcactcgttatcccggagaacatattctggaaacctctcaacaacgtttcctaggacaagccaaaagcgtattccacctcggtgaaaacaatatcctaagcgccgggctcgaatatcaatacgatcatttgaaatcccccggcgtatcgagaacgggaaagcctccgtatttacggcttccgcttatgtacaagacgaatggaacccgacggatcggttgaatgtgacggtaggtgggcgcttcgtcgtgcaccaagagttcggggctacgtttacccctaaagtctccgccatgtacaaactaggcgacttcaatatccgagccacatactcaaatggatttaaggctcctaccttaaaggagttgcacgatgattatatcacgcagatcggcggcggcccgtggaaacattattatggtaataaggatttaaaaccgcaaaagtccaattattattcggcgagcgtagaatatcatgcgtcgaacctgcagatcacggtaacaggattctacaaccgtatcaagaacatgatcgccttgaccgagatcccgacaagcgccgaagaccgattggatgagatcgaggccagcatgcaacacaagaacttatccaaagcccgctctttcggaggagatatatcgctcacctatcaaatcctatcttccttggctattggtggaggctatagctatacggatgccaaagcgcaatatacggatgatccagccgacccgaattatatgctctacaccccgatcaacggaacctcattccataatgccaattggaaactggcatggaaccatgcgtggaaaaagtataaattggatgtcactttgttcggccgataccaatctacccgcttttatatcacggacggtgatggaaaaagttatcagctatggcgattgaatacccgtcataacgtattgaaaaagaaaaaatggaacctagatatcaatgtcggtatcgataatatcttcgattatgtggatcgtaccccgttcggacgccatcgtggaactacgtctcccggacggacttggtacgcctcttttatcgtgaaatttcagaataaacataaactataaacaatcttaaaagttaaatgcgatgaacaaatttaagtaccttttgcttgcggcgagtctatttgcctcaaacgcagtttttacctcctgtgatgatggagacgacgacaataccgcaaacccggcggaagaagtcgtaaaggcaagtaagaaacatgacacggcgatcttgttgtgtacattcggtagcacattcaaggagtctatcaagacatacgacgctacactagccgatttccaaaacgcatttcccgatgcggacatctatttgtcatttacctcccgtacttgtgtgaatcgtgtagaagcagagacaggtatcgcacgttaccaaccggacctttggttacaagccctaggaaatgccggttacaagaaggttgcggtacagtccttacacatcatcccgggtgaggaatacctaagcttgatgaatacggacgtgaagaagaaattcatgatcgagtctttcccgagtgttcaagtcgtaaaaagcccttgtttggtgtacaacgaagaggatgtggaagccgtagcaaaagtcctatacagccactacagtgataaattggctgataacaagaacgtccttttattaatgggacatggtaacccggataaaaactataacgcaaatacgaaatacacggaaacagaagaggctatgcaagccttggccgctaacaagaatgtattcgtaggtaccgttgattacggagatatgttgttctggccggaagaaggcgaaccaaatgaggaatgtgtctattccaaacttaccaaataccgcgaggatcataacttaaaaccggaagagatcacgatctccttagctccgttcatgtctatcgccggagaccatgcgcataatgacctttggggtattgaggagggtgatgatttcagcgctgccgctcctaacgccgacgcttgctggagactaaaacttttgaagatgggcttcaagatcgacacggaagaaagccataacggaagtttagagaactgtaagatcataggcttaggcgattacgacgctgttcgtcagatctgggtgaaccatctaaaagcattatataatgatgcggaggcttgggaaaccggagaagactaccagtaaataattgagaattgagaattgaaaattagggagtacttactgaaccaattttcaattctcaattttcaattgttcagtgtgtatataatttctttcgatcaaaaatcgtcgcccgtttatatttcatggcgaaacggatgtgatcgataaataaagaccggatcgccggattctcacctagaggctttaaataaatatccacatcgaaaccctgttgacgtagccctttctgccagaaatccgtaaccgtattttccgtacctcgaatcagtacgaacataaaaggaatcaactccacacgcttatgaccggcttggcgcatttgctcacctacatcctcgatcgtagggaaaccctcacgggttccggtataataatctttcattcctttggtctggaacatataccccaatttcgcgtaagccgagttactggcatgataagttccgtgcgccaccaataacttagccccatttttagtcactccagaaggtgaggaaaccgctttcatcaccgcctcataatcggtatcatcatataacaagggattacctacacgcaaatccttaaacaaaccttttcgctgttccgcctctttgcggatcgcttccatctccacaccctctataatgatagtcggttggattatcacatgggtaaacccttgatcacgcaactctaccaaggcgtccgccggcaactgaacccaaacaccttgcgccctcaaccgactcactacgctacgggcgctataagcctgccggacttccacgtctgggaaagcctccttgacacgcttgttcatcacatcgagtacttgggtacgagcttccgggtaagcactcccgaaatgtaccatcaagatcgctaacttatctcccttttccatgctctcccggatatcggaagcgtaaaactcccgcccgggtttcgcccataatgaacaggcgagcccgagcaggagtgaacaaacaaacatggatcgtaaaaatcccctatacattattatattagttaatagttgacatgtgacagtttactgcttgaaacggaccagaaggctgacgtaataggtacggcccggggtcaatgtagcgtaattgtaattaaagggacgatcatctacataatcaaaaaggttctcgatacctactcccggttccaacaagaaatcgccggctctaaacgtatggctcgtattgagattccacaaggaatatttcggtgcgtatccataagaagtagaataacgttccccttggatacgtccgttaaaattcacgttcagcttatacttattccaagtatgagaccacatagccgctaccgtaccactatgcttaacggtcttatccaaaggctcatcctcatatacgttttttccatccatgaaactatagccaccattcaaggtaaagcccgctcccagataactattgaaggccacgttaatacctttgatcttcgctttatcgatattcgcacgcatctgtatctcatcatagtacgtaccatgggcggtgttataagcatcccgttccgccgtatccaacatcttatagttaatcatgctacgtacgttattcataaaagcggacacggacaaagagaaataccgcatcgtatattctgcgctcaacgtaaaattgtcgctcttctccgggtccagatccggattaccgatcgtaaggcgagtcgctccggacgctttcttctccgattccgtatacaactctttcaattcaggtgtacggaaaccagccgcatacgatccgcggaaattaaaaccgcctaccttatacagcaaagccacgttaggagtcgcataactcttaaaattctcatggtaaatatagcgcaaacccgcgtacgcttggaaatgctcattgatattgatctcgtcttgagcataaagcgcagtcgtgtacatacttttacccgctatgttatccgtctcgctactcagtaactctttaatgaactccgcaccagccgaaagcttattatatttgcccaaacgaaagattcccttgacattcaagttatggtaatgaatccgtttcgtcatatcactctctccgcttttctttccatcaaagaaatccttatacgtactatgattgtccgacagataatcagcgttcaaataagagttcttattaatcatgtattgagcgcccgccccataagtgaacgtctcttttctcatatcatagttggtcgtattcactttatccattggcatcggacgatcgctggaacgtccgaagaaagtaccacgcacataaaaagacaaacgatccgtagcgtcgtacgtgaaacgttggttgatcacgttccggtgaaatccctcggaagcttgcttattggtaggaaccaactcgcctttactctccgtatagggatttaattgccaaccatcggcccgttgatattgataagaagtatatgaaccgaacttccctacattcacgtccgcattgaccgactgcaagaattggttcttgctaccataacggctattgctcgtcacgttcaccttattacgggaatcatccgtgatgatattgataacgccggcgatcgcatcgctaccatacaaagcggaagcggccccgttcaatatctctacccgctttacgttagacatatcgatacgggaataggtatcatcgccggccaaacgcttaccgttttccaagataaccacgtatttctctgtcaatccgttcatattcatcgtagccccctgtccgttttccataaatacgatactcggattcagcttggtcatcgcatcttggaaattggttacgctcgcctctttcaagtcttttcccgtaagcactttcacgggaataggagaattactcatgcggcgatgcgaaccggtaccggttaccaccacttgatcgatattcacatacttttctttcagcttaataacgacatctttttccgagtgatccgtttgatacacgccctgttcatagccaaggtaagtcacacgaatacgatgtctaccatcgggaaggttcagctcaaattttccgccggcatccgtggttgtaccattcaaggattccgacacgcggatattcgcgcccgggattggttcattactttcatccacgaccttaccctgtaaacgtacctgcgcaaatgatacgtttatcgcacaacttacagctaaagccgcgcacaaacactttcttttcataaacgatttgttattatgtatatttccgctttcctgaccccgagaaaaacagcaataaaaacgcttggcaggtttcctgacttacttcgtagagaacgaccttcccgtcttttacagacagtggtatgagaaatgttttctactttacaaaagcttacagtagcgggcactgctccggattcacaccggattccctctttatgacgaaaccggatggtttttacgtcatcaccaaaacgggggcaaaagtatgaattattttatataaacaaaaatatatcccggcttatgttctttaatagctttacaaagagaagcttataacacatcacatcgccaaaaaggaaaacaaaagcaatcatgcaagatacaaagttttccaaaactttttacaactcactgtaaattaatatattaacataatttaatcagcaaaaagttttccaaaaagaaaatcatatagagtaataagatacctttgcacgcataatcaatcacaaattaatcgacatcatgatacagacagttgttaaacgggacgggcgtatcgttggcttcaacgaggagaagatagtaaccgctatccgtaaagccatgttgcatacagacaagggagaagatatgcaactgattcgccaaatcacagaccatatctcattcaagggagaacctcaaatgaccgtagaggcgattcaagatgccgtggaactggaattgatggccagtagccggaaggacgtagcgcagaaatatatcgcttaccgaaatcagcgaagcgtagcccgcaaggcgaaaacacgggatatgttcttggagattatcaatatcaaatccaacgacatcacccgtgagaacgcgaatatgaacgccgatacacccgccggcatgatgatgaaattctccagcgagaccaccaagccgtttgtcgatgactatttattgagcgaagaggtcaaggaagccgtatctaacaactacctccatattcatgataaagattattatccgactaaaagcttgacctgcgtacaacacccgttggatcgcatcctgaaatacgggttctccgccggtcatggcgaatcacgtccggctaaacgaatcgaaaccgcaagcatccttggctgtatctctctagagaccgcccaaaacgagatgcatggcggacaggcgataccggcgttcgacttctacctagctccttacgtacgtaatagctttatcgaggaagtaaagaccttagaggatttatacggacaggatttctcccacttatataataagcctatcgacgattaccagacacagaccttggatggattaagcggtgatagacgcgtcatacaacatgccatcaaccgcacggtaagccgtgtacaccaatcgatggaggcttttatccataatatgaacacgatccattcccgtggaggcaaccaagtggtattcagctccatcaattatgggaccgacacctcggcggaaggtcgttgcatcatccgggagttattaaaaagtacttacagaggcgtaggtaacggcgagaccgctatcttcccgatccagatatggaaaaagaaacgaggcgtaagctatctgccggaagaccgtaactacgatctttaccaattggcctgcaaggtcaccgcccgtcgtttcttcccgaacttcttgaatctcgacgcgaccttcaaccaaagcgaggattggaaagaggacgatcctcagcgctatatccacgaggtagcgaccatgggatgccgtacccgtgtattcgagaatcgtttcggaccaaaaacttctatcggacgaggtaatatatccttctcgacgatcaatatcgtacgattggctatcgagtgcatgcaagtggagaataaggaagagcgtatcgccctatttttcgctaaactggatcatatgctggaacttacggctcgtcagttgcatgagcgtatggagttccagaaaaccgcttacgcgaagcaattcccgttgttgatgtcttccttgtggttaggctcggaaaaattgaagcctaacgattcgattgcctccgttatcaaccaaggcaccttgggcatcggctttatcggactggccgaatgcttggtagcccttaccgggaagcatcatggcgaagatgaggattcgcaagccttaggcataaggatcgttacgtatatccgggatcgtgccaaccaattctcggagcaataccaacacaattatagcgtactggcaactccggcagaaggtttgtccggcaagttcacaggaaaagatcgtaagaagttcggatcgctccccggtatcacggatcgggattattatacgaactctaatcacgtcccggtatattataagtgcagtgcccgtcataaagccgaagtggaagctccttatcatgatttgactcgtggcggccatatcttttacgtagagatggatggcgacgctacgcataaccccgaagcgatcatgcgtgtcgtggatatgatggataaatacaatatcggatacggttccgtaaaccataatcgtaaccgttgtctggattgtggctacgagaactccaccccgaatctggaagcctgcccgaaatgcggcagcaaacacttggacaaacttcaacgcatcaccggttacttggtaggaaccaccgaccgttggaacaacgccaagctatccgagttgaacgaccgtgtcacccacaactaattttcaattgtcaattttcaattttcaattaccatgttgtctatcatagatatcatcgaagataccaccgtagacggtccgggattccggaccgccatctatgcggcgggttgcccgaacaaatgcccgggttgccacaaccccgaatcatgggacatccataaagggaagaaagtaagaacggaagagatcgtggagaaagtgctggctgacgagttcgccaacgtcaccttcagcggaggagatcccatgttccagccggaaggcttcaccgaggtagccaaggcgatcaaggaaaaaagccaaaagacgatctggtgctacacgggatataaattcgaggacctgataaagaacccggcacaagccgccttattatcctatatcgacgtattggtagatggccgctacaaacaaacccttcgggatgagagccttttattccggggaagcagcaaccaacggttaattgacgtacaagcttctttaaataaaaaggaaatcgtaaaatacaagtacgatccttttatttaaggcttttaaggcacacacatgcataaaatcttgtacggaataagaaataaacatccgttctcttatatataaagagaattgcatcagcatctattcctcaattttcaacgtggtctgtacaaaccacggcgtggtttataaaatccacggcgtgatccgtacagaccacggcgtgatttatagaatagaagcgcattcaacaaagaatatataagtatccggataattattcttactgaagcgagacggatattagcatgatttcatacctttgcatccgaattggttccgtacgctcgttcgggcatacggattaaaagggaatccggtgagaatccggtacagtcccgctgctgtgaaactcctttaacattctaatactactttcgccactggcctagtaagccgggaaggcattagaatgggagtcagtcagaagacctgccattcatttaagattcatatcctcgtgggttagggtatagagaacacatatataagaacaaaaagaagatgatgacagacaaggaagtattgttattacggcgcaaattggatcttttgctccgtacgggaaaattgttgatggaaagtgccgccgatacgaaccgtatcgagcgtaacatgaagcgggtggccgcctttatggggattcccgaggagaaattgcatatcgatatccgatggaccatgattatggtgaacgtaagcgatgagcgaaactcattctccaaattccagaaatgcgagaaacatggtattaacatgacaacgatatcacaggtcagcaagctctcatggcgggcgatcgagcaagattattctttggataaatatgaggaagaattggaaaagatagttcgccaacctcggaattataccccttatatcgtagcggtcggagcaggattcgcttgtggaggtttctgtaagttatttggaggagactggatcgcgttcttgttaacctcgatctgtacttttatcggtttcagggtgcgtgcccgttgtgtagaggctggccttaacgcctacatggggatcgctcttgccgcctttatttgtacttgcctagcatatgcctcatcttttctgggaatatccgatactccgtatctcccgttactggcttgtgccctattcatcgtaccgggcgtacctttgattaattttgtagacgatatgatcgataatcacttgctggtcggtattacccgtgccgcaaacacggtgatgatggtagcggcaatgactttcggtatcgctttcgccttgcgcctgctcgtgatgaacgacgtatcgatcgaccataaattcagcgaactaagcatggtcccgcatgatccgtattacgtatatgcgatagcggctgccatatccgccgttggtttctctatgatattcaatatccaacgccgtttattatgggtggttgctttaggcggtattatcgccgtatgcatccggaacttcgtgaacttcgagctgggctatggtcccgtgatcggctcgtttatgggaagtttcgttgtcagcctgatcgcagtgaaagcggttcattggttccatgtaccgaaccatgtattgacgatcccttctgttatcccaatgatcccgggagtattgatgtatcgctcgttattaggttttatcaaccttcacggggtgatcggcgaggttacgaacgccttctccaatggtattaactccgccctcatcatcctttgtatctctttaggcgtagccgtccccaatatcttcgcccgtcgttacatcgccaaagaccgccaacgttatctgcaagaggaattggagaaacgcaggcaaagaggtaagtttatcgagtggtgatttaagctggccattcgtgggtattcccgaccgtcaaaatacatatttataggtattgccgagactaataagatatcggatatttgctttcgttatcaaactataaaaacaaatagaaatgaagactataggaatattctacggctcgtctacaggaacgacggaagggatcgcgaaacgtatcgcagagaagctgggtgtggaagacaaagatattcatgacgtatctaacgcttctcccgctgatgtagcgccttatgaaatcttgttattgggctgttccacttggggcgccggagatttgcaagatgattgggatagttatctagggaaactgaaaaagctggacttaagtgagaaaaccgtcgcattattcggttgcggagactcagcctcttttagcgacactttctgtgacgccatcggtacgatctattccgacctgcgaaatacaggttgcaaattcattggcgctgtagatgcttcgggatattcatttgacagttccaccgcctgcataaacggtatgttcgtcggacttcctttggatgaaatgaatgaagacgatcaaacagaagggcggatcgaccagtggttggcatctataaggaaagaaggaattgaatagacgcacacttttacatacataactgtttaaccttaatattacaacgtttgcgtattcaacttgattggtttagatttatgaagaggtatgtgggtcaaacatacctctttcttttcatctcagtttcctgaattgtttctttatccaaaaataatagccggttatcgcgaagatcgtccccaacaaggaaactaagcaagtcaatatacgggtagtcattccccccacgagccgacgtgtacggaataaatccatcctcttatcttccccgattttgggagatctttatataattggacttccgtaatctcacccgtagcaggatcaaaggagtaacggtcgcttcctctcgtatttccataacgggccgtagaaaccgtagcggagccatcttggatcgtgattgagttaaagtccggataatggcttttcaatgccgataacacctcagcccattgtgtgtaatccgtctttttcttcgcgggtttcttcgcgccggaagaagctggagcatgatgcgcttgaggcgggtttgcactaataccgaagacactataaaaggcatttcgataccaaccaaacgaccatgttaatccggttaacgctaagataagcaggagcaatgccgcatagaatcccccggagacatgtaaatcatagaagaaacggaaccaaccagccttggtctttactttcaaccggtttctcaatacttttttattacggggataccaaattacgattccacttataataataatcgccaagaccaaagtcgcatagccaactattgattttccccaagaaaaacttccatcccgtttatactcatcaagtaaccaacgatgaagacgcatcattttcaggaaaaaaccttgtccgtcatccatcccggtcacctccccggtgtagggatcaataaaacccgcggcctttttccccggtaatatcagttgataagttcgtctcgggtcagacgatacccgaataccgtttattcgaaccgaatcgggtaattgttggcgcgccgattctatcaaggtggcaggcgagagaggttccccttttacttcctttacaaaataacgggaagggtagcctaattctaatatctctgtctcaaagacgagaatcgccccggtcaggcagacaatcgcaataataatgccaaaaggtatcgatagccataaatgtactttcgcaaagaattttctcattttccgaataattgtttaatcccgtcatatatacccggaaccgctaccgttccatggttctcgtcgggaaatgatttactaaagaaacgcaggttctccgcttgcggtaaaagctccgaaagaagataactcactttgtcaagatgaatgtccacccggtccgtcctttttttagacgcgacaccgatatacaggcttttccctttaaaatcccggcctgcaaccaaagcctccgcctcccggaccaaccgcccctgatcccaccacaaactagggtcgaccgctagataggtatcaaataattccgtatgacgaagaaacatattcaaggtgaaaagccccgcatacgaatgaccgataagcatattccagccgttcgtgcgataggcactatcgatagcagggcgaagttcttccgtaagaaacttactgaaagcctcacttccccctccttgcggaatcgcatctatggagattttaccatcccgtccggcggctgaagcggtaggcgtaaaatcacgtgtccgatccgtatttaataccccgacaataatacagggaggtagatatttacctctaccggatgccaacgttttccttatgcctaccagcgaatgaaagaaagaatctccatctagcaggtaaacaaccggatagcgttgtttcgtatccatattataatgctccggcaggtgtatccaataactccggtcttcttgcaatacggtagagtacaaaaccagttcctttcctatacaaatatcctcctggctccgcagggttagcgggagcaggaggaatattaaaagaatgtgagtccgactcatacttgcttattattcttgagcggcagtcaatttacctacaccactgatttgctctgcctcaacggtaagaccttttgtagcggtagctgtcttcggatcgatacgatacacggcaggttgacttccatcggtagtcgtaaccgccatataagcgataccatcctccgagaacggagtattgccaaatccggaaataacatccgtggaaggcagccccttcacgtaagtaagactcttatcctctcctttataaatagccaactctttcgcggcgaatccggattcagtcaacggacgatcatacatcaacaacaagaaataatcttccgtgatatgccaacaacgcaagaatgccttaccacccgtctgtgcctccaaattacaataataatcaggatcaaacccctccgcgttagccttaatacgaactacaccggccggcaaagtcgttttctgtacctccgcggtcatcgtcttggcatagctgggcgagaacacatacacatcgccgttgtctgccgtccaaatggtctggtagtattgagaacggttacgtccgcaagcataactgatcttatccgtctttatcagtttcgggttctcgaatttctcgttcgcataaatagcgacccaagcctcgttcggatattgcgtccattgcaattcccctttttcgtaagcgccactaccgcttcctccggattcagtctttaccagctccgggtatttaacatatttacctccctccgctttcacgccgtacttactcaatcccatcgggatagccgcggaatagatccggccgttcgcttggagaatacccgctaacgtaacaaactcgccatttcccaaataattctccgacaagatcgtattcgtgtttgtcgtaaacgtctctttggccacatccagataagagagcaagaaacctttaggcagataaccattctcgtccgcatattcctcacccagatcaccggtagaagatgtaatgatatagtcaccgtagataccataagaagtaaaccgcttgatctcgtaagtattatcacgctccttaaccttgccttccgtattcagtacgtatgaagaagtaacaccggcatttccttgattgtaaaccaaacgatacaaatatttatccttatagaagatccattgcgtaccgctttccgtagtgagtccgttgtttttagcggagatagagccatcacccagcgtatcggctgtcaacaagtaattcgcgtcaccgacagaagcggcaactacatagctcgaaaccacctccgaggtcgatcctccgccatttccattcccgttgcctccgttatccgggtttacaggatcgtcgtcactacaagaagtaaatactcccccaaccaataacgcggcggcaagacctgtcattaaataattcttcttcatgttgttttaatctattatgttttgaattaattattgataaataaaagatagtcacactttaaattaattaccgaaataaaccctcaccttaccatagaaagccctgccagccttctgcaagctgaagttatcgtataatttctcgttcgtgagattcctgcactcgaaagagatattgtaacgcccgttctgtataccataagagagtgtcaggttatgcgagaattgagttggtaccacaaattcggattcactgcctactgcctccgaatacagcgggaaactatgcatatataaattatcgtaagtgacacttagcgtattgcctttcttccacaaattgcgccagtagaaggtcacatccgagttggcaaactgataaggaagattcggcatacgtgcgccatatgtcaagctctcttggttcgtcccgctggtaaccgtcttcacgttatccctcacattcatctgcgtaaagtttcctcctacgcttacccagttagcgaaaccgtagcgaaccgagatattgtaacccttggtctctacacgaccatgattcacataggtagcgccatatttaccgccgctcaaatccgatatattccgttggatataatctttcgtattccggtagatcaatccgccttccacatatacggaatgcttaccgaatgtctcgttgtagcttaaattcagattcacattatcgctgttctccggtttcaaggaaatatcgccggtctcaaggtcctcatcgccaaacatctcctcattggtcggcagacgataggctttctcataggataatttcgcttgcaagcttttcaagataaagtaagttcccgcagccccatatcccatcgcgcttaccgaattggtcgtacgtatatagtcatcttgagccgaggaagtagcgacaggccctgcgataaactggttgtaatatttaccgaacacagacaagttccaatgttccgtcggcatcaagcgatacgaaagaccgctgatatttttacgggtttccttcgggatagcgttcgcttccgagtcctcgttcaaaagagactgattcgaacgccggaacgcgttgatcacgtgattgaacgtgaatgtatgtgccttaccgatacggtagttagccgttaaggttccgttccagttattattatccgaccgggtgttctgataagattgctcaccgggcatccggagcggacgcatctcgccacgccaattatattcataggaagaggtatctacattgttcgtcatgttcttattataattcgccgtcaataccaaatccaagcccctaacgaagaaatcacgcttgcgatagtccaacgacggcatgatcgagtatcccttccgatatttgccgccaaacaccacttcttggcgtacgcccgtctgtatatctttatacatatgtgaataggtaaacccgaacatcaaacgatccgcccatttcttatccacgaaaccgattttcccgataacggcctcgttatgatacgtatcatgaaaacgcttcacatgctcgatctttttcttattgatcgctccggtcgtaaagtccttcaccggagtatccacatagtaattattatccgaataattctgaaaaacgttgatctcatacgtgagtccgctccggaaagtttgtccgaagttcacataagatttatgcgtattgaaagacccgtatgaataagaagcatccaagaaccatttgtcccggttcttcttggtgatgatattgataacacctccgatagcgtctgttccgaaacccaccggtaccacacccttatagacctctatacgctcggcataattcaccggaatgttattcagtccgaaagaactgccgacaccttcttgcggaaccccatcgataaagatcttgatatgcttgccggtaaatccatccatcatcagttgcatatccgagccgacaccgccggactcccggatcttcattccgggcgcttgagccaaggcttcactcaagttctgggttgaattttgcaaggctttcgtatcgagggccacggcattgaacgcagaacgcttgagccgggtcacgccattagaaacgacaaccacctcatccaactccgtagcttgagggctgattaccacattcatctttgtccgttccccacgcatcagtttcacgggtttctctaccgtcttatatccgatagccgatactactaatgtatattctcccgcgggagcttgaagatgatagataccttcctcattcgtagtcccgccgtaattcgtaccttttagataaacggtagcgaaatccacggttgttttttccgtggacaggactttgcccgatatcattgttttatgttgagaaaaagccgagatggaaataagcaacagtaaaaaggagaggaaaagccctctgattttcttcatcatcatttaatcaattatgttatttaaaacgttgcaaagttacgatcagagactaccgccccacaatacctaagaatgggtaaaatcacattaaaaatctacggaggtataccaaacaatccccttattcaggtaattggatgtatggagtaagttcgtaaaattgagttatgtcaaattttaaatctatttaaacccaatcgtaggtttttgaggtactttttcttaataaacttcaaaaaggttaactatatttgcgagaaacagatgtttaattttaattctttatcaccatgacagacagaagaacatttttgagaaacatttcattacttactttagggggcatagccagccaaaaagtaatggcttcaaatcccaccagatccatacccgccacggatgcggtatcctcggcaaccgccgggaaaaagatgggattgcaaacctattcgctcggacaggagttactgcaagatatgcctaacgggttgaaccgattggcaaaagcaggatataccgatctggagattttcggatatagggaagacactggtaaattcggtgattataatcctaaaaatacgacattcatcgcctccaaggattataagaaaatggtggatgatgccggtttgagaatcagcagctcacacttgaccccttctcttcgtgagtacacgaaagagaatatgcccaaattcgacgagttctggaaaaaggcaaccgatatccatgccgagctaggtgttagttgtatggtacaaccgagtttaccccgtatcgaaaacgaggatgacgccaaagtagtatcagagatcttcaaccgtgccggagagatcacgaagaaagccggaatcctatggggttaccataatcatagcaatgagttcaaacgggtattgaaagccggagagaaaccggaacagaacccgaatccgtgggcaccacctaagggtacttatatcgaggagttattcctgaaaaataccgatccggataaggttatgttcgagttggatgtatattgggccgttatgggacagcaagatcccgtggaatggatggagaattatccgaatcgttttaagttattgcacatcaaggatcgttggatcatcggtgattccggtatgatgaatttcccgaatatattcaagaaagcgtacgagatcggtatcctcggctactacgtggaactggaaggcgacaagaaaggccgtacccagttcgagggcgtagagaagagcgccgcctatttgcaagccgctccgttcgttaaataaaacatcccgatttatcccataaaaaagacagtgtttccgtagggcgatcatatgcttgggaacactgtctttttgtttattttgccttcaaaaaaacacgtacgtcttttttcggaaacatgtacatgtttttcacgaaacacgtacatgttttttcaaagggcattacatgattaaaaactcatctttacaccggcaaaataacttctcgggctagccgggccatagatataggaggaatcccggttcttaccttggtcaaagtcggattggtaagcgttaaacagattctgcacgcctccatttacttctagtttcagctctttgtaaagcgggaactcatacgcaagcttgatattcatatcaaagaaatccggagtctccaccgccttatccaaaggtatatatcccgccaaatgctgcaccaacatacttcccgtataggttcccgacagggaagccgtgaaacgtttgaaaggcgtaagggtagccgtaaaataaccatagatatccggcgtacggaacatctttgtctcggctggcacattctcgtcatcgctccatttctcggcctctttataacggcttcgctggaaagtagcgcccgcttgcaaagatagccatgaagttaacaccgactttccttccaaggttaatcccatcactttcgccccggaaccgttacgacgttccttaatcagattgccttgctcatctttcccaatatcttccaagacaaacacatcacttaagctggagtaaaaaccttccaccaagaagttcaactggataccattcttaaaacgatggtaaaaatcgaccgaagcactcaagctctgcgatttctcctcggataaatctttcgcacgctggatcatagcgacctctccgccgaccgccgagatatgcatatcctcatcgaacgcttgcggggcacggaaaccactggaataactagcccggatattgatatcttccgtcgggttaaaacggatattcgcacgagggctgaatattacatgatccatcatattatgtttatccaaacgaccgccaatcaagaagctccatcgcttatttttccactcattctgcaaaaacgcactctcgatatgcaccttctgattcgtaaagcgattatacccgatcatctcgtctttcaaatgatcgaaactatactccaaaccggcagtcaaatccgatggcataaacaagaatttatcaaaactataagcatattgcgtaccggccataaccgtcaggtccgtagtcttgccgtaagcgttcggatcttggttcgtcccgtaataactatcccggtctgtattctgggcagaagtgaaaacactccatttatgtttgtaatccttggagaaaagatcgaatttcagacctcctccatcaatcgaatgctccaactgttcggcgatatccgcttcatgaggcggacgatccaacagatttcctcccctgcggtattcattcatatgatgatactcgaatgtcaatttactataagtactcgttttcaggtacgaacggaaaccaaccgtttgattcttcaatttaggcaactccgtaaaaccatctccatcctgatcaaaaccggaacgatgacggttctggccaaaaagatataagcccgctttcccattttccgataccaaagaggcatttagggtcgtattattatcgaaagcagatgtcccgccaatcgaggttaacgtatgcgacaattccccggaatttctcaagggctccttcgtgatgatattaattgtcccggcgatagcggacgagccgaacagtgccgatccccctcctcgcatcacctctacccgctcgatcatattcgccggtatttgctcaagcccatatacgccggataaagcactgaatatgggacgtgaatcaatcagtatttgggtataaggtccgtctaatccattgatccggacttgctggaaaccgcaattctggcaattcgtctccacccgtacacccggttggaaatttagtccctgtgccaaattcaccgcattggtcgtagtaaaaaccttcgcatccaatacattcactaatgtgggagccaaccggcgggaagtttccgcacgattcgcagataccaccacgccatccaaggcgatctggtcttcttccagttctacattaatctctaaggtttttcctttctttaggctcacttctttagagacagtcttatacccgagcgctttatattccagcgtaaatttaccttccggcagattcttcaggaaataatgtcccgagttatcggtggtcgtaccgatcgtggtaccttttaacaatacgttgataaagggaagatgttcccctgttttcttatccaagacatgtccgaaaacatttgcgtctgagtcgtttagacggtcctctcccgtggcctgagctaccgttagggcacagcacaggcatagtataaagatgaaaaatttattcattttaatttattctgataagtaatacaatgttattaatctcacaatatcagaatatgggaggagcccgaagcgtacgtcttccccggaagggaacgatatagtccggatagaccggagcgaaagataagttacggataaaggaataaaaagccgccagcagaatagcgacgaaagccgcacctgttatctgcaagacagataactgatgaagcaactgaaactcggcgtagccatgttcatggtccggacgaccatcgtccgttttatgatacgggtgagaatggacgattgttaccccgttgacaatatgaacgtgggtaaacgcaataatacatcccaaataggctatgaacagcgcagggagtaatatcctcagatattttcttaatctatccatctcttttctctcgatcgcaaatatagtaatataaccgataaaagagatacgctgttcaaaaattacctatttgtaggtatttcatcaaccgagtacaccacgtacccgatcttcaaaggccgaaagggccgctttggcgccttctcccatagaaataatgatttgcttaaagggtacggtggaaacgtcgcccgctgcataaatacccgggacattcgtccggcaatgtgcgtcaatcacgatctcaccgggacgatttgtttcgacaatctccttaaagacaccactattagcggctaagccgatttgaacaaaaataccgtctaaatgaataacacgctcttcccctgtcttacgatcctttgtacggataccggttaccttgtcgccatttccaaccacctcggttgtttgtgaactaacaaagatctcgacattcggcaaactcttcgctttctcttgcaagacttgatccgcttttaactcatccataaactccaaaacggttactttcgaacagatccccgccaaatcaatagccgcctcgataccggaatttccaccgccaaccacggcaacatgttttcccttataaaacggaccgtcgcaatgaggacaaaaagccactccacgccctatatactctgcctcacccggtacattcaatttacgccagctagcgcccgtagcgacaataaccgccggagccttgaatatctcacctccagccgtagataaaaccttctcgtttccttctatcgttaccttctctatacgacgatgctccagcaggtcaatcggatattgccgcatatgcaagcgcagattgtcagccaactgggtacctgttgtctccggaactgaaatcagattctcaattcctaccgtctccttcacctgcccgccgatacgctccgccacgacagcgacactcagcccctttcgtgcggaataaatagcggcagaagcaccagccggacccccaccgaccacaaccacgtcatatcgttttaccgtcttctccgtcaggctctcattgattccatactgagcttccagcttcgataacaattcaccgaattccccacgtcctacatggatcagttttccatccgcaaagacagaggggacgccttgtatcttcaaggcatcaacttccgcctgattgatagccccatctaccatctcatgatggatctgaggatttaaagtcgtcatagcgtttaatgcctgtaccacatccgggcaattcgtacaagtcaaagagacataggtcgtcagatgtatcgagccattcaaggctttaacacgattacaaatactctcgtccggaaaattcttgcctttcccatctgaattcaagatcgccaacagcaaggaagtaaactcgtgtccattaggtactccacgaaacttaatccccgttttcgctccatcctttaataaaatgaattccaatccatccccatcagatactcgcatagatattttatccgaacaagaggcaacatcacctaataaatccaacaactcttgtctactttcatgcgcaggagagatcgatatatcaaaggtataattcgcatttaaccctgcgaatataccttttaattgttcttttaatgttgattctaacacgatctatactcttaattatttagattttccctaccaagtcaatgctaggtttcaaggtagcctcccctttcttccatttagcgggacaaacctcaccatcatgtgaagcgacaaactgagcggcttcaactttacgaagtaactcggaagcgtcacgaccgatattgttatcatgaatctcggccactttgatctttccttccggatttaccaagaaagtgccacggtatgccataccctcttcctcaatcatcacaccaaacgcacgactcagtgctccagtgggatccgccaacatcggatattggatcttacggatagtctcggaagcgtcatgccaagctttatgtacaaaatgagagtctgtacttacagagtaaatttctactcccattgatttaaactgctcatacttctcagccatatcgaccaactctgttggacaaacaaatgtaaaatcggccgggtagaagaaaaagatagcccacttacccaaaacgtcctcgttggttacagtcttgaaattaccattttgaaaagcttgtactttaaactccggaagttgagaattaataatcggttccatacttgttcctatttttaaatgaatactatttgtttttatttccgatacaaaaatataacatatttcttcattaaaacaatttttctaatcgatatattttatgaggttatagataacactttatcaatcaataaaaagggcctatcctcacggataagcccttcaatatcttgggttttggattactacataattagcgattataatttactttatatacttaattgattcttttgtatccgtatacggcacggtctcccaattcctcctcgatacgaagcagctggttatatttagccatacggtccgaacgacttaatgatcccgtcttgatctgtccgctattggtagcgacagcgatatcggcgatcgtagcgtcttccgtctcaccggaacggtgtgaagtaacggtcgtgtatccatgacggtgagccatctcgatagcgttcagtgtctccgtcaaggaaccgatctgatttaccttgatcaagattgagttaccgcaaccttctttaataccccttgaaaggaactctacatttgtcacgaacaaatcatctccgactaattggcaatggttaccaatacgatctgtcagtttcttccaaccagcccaatcattctcactcataccatcctcaatggaatcgatcgggtattcgttgatcagcttttccagataatccacttgttcgtcggaagtacgtttcactcctttttctccttcaaacttcgtgtaatcgtagattccatccttataaaactcagaagaagcgcaatccataccgatcatcacatccttgcccggttcataaccagccgccttgatagcggcgataattgagttcaaggcatcttccgtaccttccaaattcggggcgaaaccaccctcatcaccaacagcggtacttaacccacgatcgtgcaatacctttttcaacgcatggaatacctcagcgcccatacgtaagccttccttgaaagaagcggcacctaccggacgaatcataaactcttggaaagcgatcggagcgtcgctatgcgaaccgccattgattatattcatcatcggaacaggcatcacgtaggtattcgttccaccaatatatctatataaaggaatatccaaataatttgcggcagctttcgctacagctaaagaaacgccaaggatagcgttcgcacctagtttcgatttagttttcgtaccgtccaaagccaacatcgcatgatcgatacctatctgatccaaggcagacatccccttcaatgccggagcgataatcgtattgatattctcaaccgctttcaatacgcctttaccaccataacgcttcttgtcgccatcacgcaactccaaagcctcgttctcgccggtggacgcaccggaaggcacagacgcacggcccataacgccggactctagtaaaatatcaacctctactgtcgggttacctcttgaatctaggatctcacgtcctgtaatcttttctattttcattgcttctacgttttttaaactgacgcaaatatagatggattacttgaaccgtgaaatcaccacaaattgctattttcacctcaataatacctgaatgtaggtagagactacaacactcccgcccgcacccggctcaaagattcgggtgtcatcaataaatacgaggcgatatgattgacagaagcacgtttcgctgcttccggatattcctgttgaaaacgcagataacgttttcttgccgactcaaaacgccaagagtccgctttctcttgcgaaagcatcaaagcccactccagtattttctggtacaatctattaatagctaaagatgttttcaataaatcgctaaattccgaaaaagagatccggtgataaaccgtcggttccaatgcctcgattaataaacgcgtcggttctctttggaatgtgctggctatacaaataacgatatttccctcacaggagaaatgctcggtaatatcacgtttattcttatagtaaaactggcgtaataatcccgattccacataatataaatatttagatatttgtccgttatccaacaataattctcctttcgcagccttacttgattctatgatcgaggccagagaatccaaatccgcattgggtaatggataaaaacgtttggatatcatttcggctatttcttgtggtgtcttcatactattcatcattttctgatctatatcattttttatctccttacaaaaatagatatttgttgcatataacaaaacaaacacatattaaatagtcaaggttagtctaggcaaaaaattattactatcgtttaaaagctaatcggattagattgttttccctgattagctgttgcataatcgcaaggcttgatcgagagatcaggccttgttattttctggtttgtagcgagagaatatcgctttcgcattatctaaacgttcttttgataagggttccaccccctttaacggataatcgaggcctaattgctcatatttataggttcccatcgtatgataaggcaataattccactttgcgaaccactttatatgaactgacataccgagctaacgcctccagccactcgtcattatccgtatatccggggacaataacatggcgaatccaagtatctatgccacgtctctccaattcatccaagaacagaagcgtattatcctgcttgacacccgccagtaacggatgtaaatccgggtttaaggttttgatgtccaataacactaagtccgcataatccaagacttcccaagcttttgaggtacatacgaaaccagatgtgtccaaagctgtgtgaagaccttgctcttggcacaaacggaaaaactctttcagaaactcaggttgcaataaaggttccccaccggtaacagtcacccccccacgggcgataaaactcttataccgtaaaacttccgtcaatagctcgccgggagtcatctgatatttcaccttccctttcgggttccaagtatccgggttatggcaatacaggcaacgcaacgggcagccctgcataaaaacgacaaagcgaattccgggaccatctacggtcccgaaactctctaatgaatgtatcttaccttttatcacttacagtgaatggttaatggttcttgaaataacatccaactgttgttcacgagtcagtttcacgaagtttaccgcatatccggatacacggatcgtaagttgcggatatttctcgggatgttccatagcgtcgatcaacaaatccttatcaaatacgttaacattcagatgctgacctccatccggagtaaaatagccatccaataagctaaccagattattgatctgcatttcacgctcctttcccaacgtagccggagaaacagcgaaagtataagagatgccgtcgtgcgcatgctggaatggaagcttcgctaccgaagctagcgcagcgatagcacctttcgtatcacgaccgttcatagggttcgcgcccggagcgaaaggagttccaccgatacggccatccggtgtcgtaccagtcttcttaccatataccacattagaggtgatcgtaaggatggactgcgtaggtttcgcatggcgataggtctcgtgctgacgcaaatattccatgaacttctcggtgatctctacagcgatactatccgtacgatcatcgttattaccgaaaggaacatattcgccctcacgttcgaaatcaaccgccaagccacgctcgtcacggatcacacgtactttcgtatcacggatagcagccaacgaatcggcaacgatagaaagaccggcgatacctgtcgcacggatacgctctacatccccatcgtgaagcgacatctcgaatgcctcatacgcgtatttatcatgcatataatggattatcttcaaggcgttcacatacactttcgccaaccagcgcatcatttgctcatacttagccatcacctcatcgtattccagatactcgccgcgaaccggctcgaacatcggggctacctgtacgccgctgcgctcatcccgtcctccgttgatcgcatataataaacatttcgccaaattcgcacgggctccgaagaactgcatctgcttaccgatcttcataggagaaacgcaacaagcgataccataatcatctccataatccggacgcatcaaatcgtcgttctcatattggatagccgacgtatcgatagagaccttggcacagaaacgtttccagttctcgggagcgttcttaaaccacagaaccgtcaaattgggttctggtgccggacctagattatataatgtatggagataacgataggaagttcttgttaccaaagaacggccatccactccttggccgcccaaggactctgttacccaaaccggatcaccggagaacaaatcattgtattccggcgtacgtaagaaacgaacgatacgcaacttgatgatcagctggtctactaactcttgcgcctcctcttccgtcatcttaccctcacggatgtctttctcgatataaatatccaaaaacgtagaagtacgtccgatagacatcgccgcgccatcttggtcttttaccgccgccagataagctaagtacacaaactgaaccgcctcacgagcgttttgcgccgggcgggtcacgtcgaagccataactagcgcacattctctcgaacgctttcaacgccttgatttgctcagaaatctcctcacggctctggataatctcttccgtgatctcttggatatccaaacgattcaagaaacgctttttctcctcgatcaagattgccgtaccatataaagcgacacgacgatagtcaccgataatacgtcctctaccatacgcatcgggcaagccggtgatgatagccgaacgacgtgcggcaaccatctcttccgtatatgcggagaaaacgccctcgttatgcgtcttacggtacttcgtgaagatctctttcgtcatcgggtctaaatgataaccgtaggcttccaagctattctcgaccatacggataccacccttcgggaagataccacgtttcagcggagcatcggtttgtaacccaacgataacctcattctccttatcaatatagcccggaccatatacatcgatcccttgaggtaattttgtctcggcgtcataaactcccttttctctctcgaccttaaacatctcggtcagcttgttccagaccttacgggtcttctcggaagaagcgactaaaaaggaatcatccccttcataaggcgtatagttactctggataaaatctcttacattgatctctctcttccaggtctcacccttaaagtgatcccagtactcattctcaaatttcataaacaatcttatctaataccacatttttaccggcacaaaggtaaaacttttatcctcatgttcctgtaacatttgcgacacccctctaaaatccctataaataggtattaaaaatatacaagaagaaacgggatagtaatgcgatgctttgcacgaagtctccattttattcactatctttgcctacagaacgtaaaagttaatctggatcaaacacatgagaaatatcctgtttaccgttttatttataggaatactatctttaatcgcatctcctatctcactcgcgtctaaatctttgcataaggcaaatatgattaatttgtcgaacaatgccattatttgcatgcatcaagatccggatggctatttgtggatcgggacttacgacggacttaacttatacaacggaaaagatacgtatgtatatcgtttcgaattaaataacaaaaactctctttgtagtaatatcattcacaaaatatccgacgcagaacccggctttttatggatatcaacctctttaggtatcaataaattctcgctaaagaaacggaaagtcaccgagtcttacccgggatacatggagagtgatctggtagcgaccgattcatccggtatcacattagccatttgtaaagaaaaccggatatcttgttacaccccatttagcgatggattccgggatctgccgagagaagggataggccctcaaaccgtacggactttattcgccggaacagacggatatttttatttactattgacctcgggaatactgaaaaagttaacaccggatttctccaatacaacttttaatttactatcggaagaacgccaattccataataaaccgatcttatccgcatttcatgagaataaccatatcttcattgtcgataccgacaataagttatatcgccaacaggtagacggaagcgggaaagaattcctgtttgatctgtctggaatgacaaataaatatggaaacatcattaagatatgtaccttccaatccaatgtatatatcgttttccgtaacggcaatattctagacctaagccaaccggaaaacacgatagacacgggcatcggtatcttttgcctgatgaacgataaaagacaggagattctttgggtagggaccgatggacaaggcatacggatgttttacgataaacccgatcttttcggctctatcttactcaaggatttaccgattaatatacagaaccccatacgttctttatatacagacaatgatcgatccctttggttcgggacaaaaggagacggaattgtccggatacaagcctatgacacttacccaaacaaaaaggcgattccacaaagcgctatcacgcatttcaccaccgccgacggattatccagcaaccgggtatatagcttccagagaagcgaattccatccttgtatctggatcggtacggaaggcccggggctctgttattattcttataaagaaaatcgaatgaagacgatcccgcagcaagaggacactccccctatccgctatatccattctatttgtgaggtaaacgactcgacattatggttggcgacaaccggcaacggattactgaaggttactttacgtatggataaagtcacgcctacaatcagtaagatacagaccttcccgctaaaaaacggggagaatacctgcaaagagattcaatccatgatatatgataacgactcgaccttatttctcgggagtcgtggcggttatggggttattagttttaacatattcaaccagaaatatgagttcctgcaaaccaacaatttaaggaatccggccattggagacgtgttatctgtatgccagaccgaggattctactttctatgcaggcgccagctccggacttacccggattaaatttaaaagaggaaagatacatttacgccaattcgataaaagcaacgggatcgcaaacgacatgatccatggcattcatgaggggaatgatagctgtatctggttaagcaccaataaaggtctcaccaaatataatccccggaataattttttccataattatcatcaaccttattttagcgtcacggaattctctgatgacgcttattggaaatgcccatactccgagcgtttattctttggaggcatcaacggattagtctgggtaaataaacaaacggagccggagcatacctatcaaccagaattaagtttcttcgagttgcaaatggataaacaaatccttccattatataagaacatcagccagaacggtgtaacggttccggctgatgtgcaatcgttaacgattgcgttcgtcgctccggattacatcaacggggagaattacgagtattcgtatcagttggtcaactataattcctcttgggaaaaattgcaaaagacaaacaaggtaactttcatgaacctcccgtacggggaatacttgctgaaagtccgttatcgtaacgatgtcattgattcgtcggcaaaagaatacaccctacctatcaaggtattacctcctatttatctaagctcattagctattttcacgtatctttttatcggtacggttttaatcatcattgccatctatcgcatccattaccaaatactaaagaaacagaaacaaatagcagacaagatcaaggaggagcaaaaagagaagctatacgagtctaagctgaatttctttacccatatcacgcatgagttatgtaccccgcttaccttgatcaatggcgtggagaattatatccaagcctatgccgccacctcaaaagacaagacattagaaaaatacacttcagtcctccgggaaaatgtagaggaactgaacgggcttatccaagaaatccttgatttccggaaagcggaagacgctggattcagtcatacgcacatccgaagagtatccgtatcctctcttttgcgaactcaattcgaatggttttacccactatccgagcaacaccaaatccaattcaagatcgatgctcccaaagagctttattggaatacggattccgtctatttcaagaagatcctagcaaatctgatttccaacgcatttaagtatacggaagacgggggcacggttcgtatctccttacatgaggaggagaacttcctcgtccttaaagtttacaacaccggcaaaggaatcgaggaggcagacatgcaaaatattttcgaccgatatcgtatccttggcacgatggataacgacgataacaggcaaaatacggcacggaatggcctcggcttatttatctgccacagcctcgtacaatccttaggtggtaaaatcgacatagagagtgaggtcggccaatatgctgaatttacagttaccttaccttttggcatcgtagaggagagctcagacgacacgatagacgaagatattcccgtatcgcttccttccccaaacacggatatacaaaagccgcaaatctcacatacggcacaaaaagagacggaagataaaccgatgatactcgttatcgacgatcataaagacatcgtctggctaatcacggaaaccctctcttccgaatatcaggttcaggaagcttataatgcggaggaggctctggaattcctcaagcaatacactccctcccttatcatcaccgatatcatgatgcctaatatcgacggattggaattgatctctcttatcaaggaaaatagatatacccgtcatatcccgcttattatcgtatctgccaaaatatcagaccaagagcaagcggcaggacttaatataggagcggatgcctatctaaccaagcctttctcgccaacagttctcctatccgtcgtgaaccgattgatgacaaatcaaagagaattaaaagagtatttctattctccggaaagtgcttatcaatatacggaagggcaattattacatcaagaagacaaggaattccttgacgccgtaaccgctatcatcaaagaaaatgtcagcaaggaaggactcggtcccgagctggtagcggacgcactgaatataaacacccgcatcttatatcgccgtttcaagaaaatatctaccatgacgccgagtgattttataaaggattataggttaaactatgcagcgcaattactcgtaaataccaacatgagcgttcaggaaattatttataatgtagggatttctaacaaatcatacttctatagggagtttgcccgtaaatataacatgactcctaaagaataccgcacaaaagaggcataaatcattgattcctaaatagtgtcataatctaccaaaagagtatcataatctgccatatgcatttcatgacacttcttcggcatttcaaagcactcttcaattcgttaagacctattaatattgctgtcgaataacaaagcaaaccgcttgtgtgtattcttccttcgggaagcacattattaacttttaatttaatgtttttatgaaaaaaaagagtgaaggtaagacgaggaaatgcctgactttattaggtggacgaacctctttgttactttgtttatctttaatgtttcagtcctcttatgcggccgaagattctactgttcctgaaatgggaaacatggagattcatcagatcgcacagcaaagttcaaccattaaaggtgtagtaaaagaccaaaagggtgaacctctgattggcgttagtattgttgtgaaaggaaccacgaacggaactgcttcggactttgacggaaatttcaccttggatgtaccggataacagcacattggtattttccttcatcggcttcaaatcccaagaagttcgttataccgggcaaaaaacattgaacatagtcttagctgaagactctgagacactagacgaggtagtagtcgtaggttacggttcccaaaagaaaggtgagatcacctcatccgttaccagcgtgaaagcatccgactttaacaaggcaccggtagtgaacccgatgcaattggtggaaggacgtgtagctggtctgactgtatcgcgtggtagcaccgacccgaatggcgaggtaaaagtacagatgcgtggtgcctcatctctgaaaggtagcaatgagcctctcgttattattgacggtatgccgggtaatatgacttctttgaacgctatcgcacccgaggatatcgaggcgatcgacgtattgaaagacggttccgcagccgctatctacggaacccggggtaataacggtgtgatcatcgtctccacgagacgtccgcaagccggaactactcaagtggattactcaggatatatcatgcacgaggcggtttataaacggccggaaatcttaaatggagacgagttcgtcgcttatggcaaggaaaccaacaacgccaatatccgcgactttggtggacgggataaccattacgacgctttattgaataagagtaatttcacccatgtacacaacttgaccgctactggtggtaatggtaagacaaactatcgcgcttctttaaattacaaaaagaatgatggtatgatccgtaacaccagccgtgaaacgatcaatggctctatcgctgtgaaccaccgtgcgtttgatgataaactacagctttctttcaatctagcaaactctttcgtgaaagtggacgcagtttccgatgatgtggataaggtaggagatatccctaattacggcatattataccaggcgatccgtatcaacccgacgatgcctatttataaggaagacggctccttctgggaaacttacagcggttacgaagatttcaacccggtagcccgcatataccagcgtaccaagaaaaaggaattcaagaatttattggcgaacttcaaggctcaatatgagattatccccggtctgacagccgccgctttcttcgctatggagaagaacgacgcattaactaacgattatagcatgcgtgaggaatatagccaatataaagacggtacaaacggacgcgccaaaaaagaatattatcagaataccaaccgtactactgaatggacagcaaactacaatacttccatcaacggcgtacacaatattaccggtttgctgggatacagttaccaagattttgaatacgagcaattcagcgccgagaacaagaacttcttgacggacgtattcggtaccaataacctagaagccggcggttacctaaaagatggtaaggccgagatgaagagtaaaaaagagaccagcaaactgatcgccttcttcgcccgtgccaactataattacgacggtaaatacatggccagcgcctctatccgccgtgaaggttccacaaagttcggagcgaacaacaaatgggcttggttcccctccgtcagcgcaggctggatgatctctcgtgaggacttcatggagagccaagaagtattcgacgtattgaaattccgtgccggtttcggtatcacgggtagtctacctaccgatccatatatgtctctcgctacctacggcacaggtgctggagcttggaacgcttacaccggttcatggctaaccgccacttacggtccgaatatcaacccgaatccggatttgaaatgggagaagaatgagtccttgaacatcggtttcgacttcggcttgctaggtggacgcctaaatggtacgatcgattggtatagtcgtacgactcgcgacttgatcagtagctacaatgcccaacagccatccttgatctacaacacgatcaccaccaacgtaggcacgatgagaaatagaggtatagaattagcattaaacgcagaggtcgtaaagactaaggatttctcttacacggctaatttcacgttctcatacgagaataataaattgacatctttgtctaacgacgtgtacaaatcttcttacgaggatcaatatgacctgccctctccgggtaacccgggcaaggcttaccgcctacaagaaggacagccgatcgcatcattcttcggttatgtatgcgatggtatcaatccggacggaacttggaatcttcgcgacatagacggaaaggaaggtctgtctgacgctgaccgtacctttatcggtaatggtttgccgaaattcaaggctggcttacagaacacatttacctataagaactttgacttcagcttcttcctgcgcggtatgtttgattatgacgtattgaacgagggtgctatttatttcggaacgactgttaatatcgatcagtctggcacaaacgtatacaaggatgccttgaagaacaaggtaacagagcaaccattgttctcttcttattatctagagaaagggaacttcttgaagatcgataacgtgacactaggttatacattcaacttcaaaaataataaatatgtgcgcaacttacgtatttatggtaatgtcaccaatcttgcgactattacaggatactctggtttaacccctgacgtaaacgtaacaggactacaagcaggtatagagaagcgcggatcttatcccaccacccgtaccttcacgtttggcgttaattttggattctaattaagtaacaatagatttaagacaatacaatgaaagctttaaaaaatatatgcgcaatttcattattgctgggagctaccgcatttacctcttgtacggacctgacagaggaaatacatagctcggtaatcgctgagaattattacaacaatgcaggcgaggtaatggccgccatgatgcgtccatggggacacttctgtggaactatgcaagtagcccaatcgccttggtcatgtaacgagttatcttccgactgtgccgcatggcctcaaaaaggtcgccacggctatgacaatggagactggattcgcttacaccgccatcaatggattcctacggatggtcaagtagtggatgcttggaaaaaattatttgaaggtatcggatatgctaacaacttccttacagatacagagaatatagattttgaagcactccaagttccaatgtctaaagcacaagcacaagcggagatgcgtgtatatcgcgcttactgttattggtatgtgatggatatgttcggtacggctccaatttgcgagaaaatcggtgaaatcaatccttcctccaaatctcgcgcagagttattcgcttggatcgaaaaagagttaaacgagagtattccttctttgtcagagagtaaaacagagacctacggacgtgtatccaaatggggggcttacgcattattggctcgtctctatttgaatgcggaaatttatactggacaagcacgctgggatgattgtatcgcagcttgcgatgaattagctaagggaggtttcgcattggataagaagtggaacgacactttccgtgcggataacgacaagcgatctaccgagattatctggtcaatcgtgtatgatgaagtatatgccaaaggaatgggttggtatcaacgttggttgcattacgcacaccaaactggctgggatttgcaatccggtccttggaacggcttggtgacacaaccgaccttttatgactcattcgctgacaacgacttgagaaaaattgagggtttcttgatcggtaagcaatatcctcgcaaagtagatgaaaacggtaattactactacgacacgaccgcagagcctttgaaaggttcagaggagtacaatgggcaggatttggtattcgtaaactacattaagtccatgaccgagggcgaagaaaacagcggcgctcgctctatcaagtatgagatccaaccgggtactaccggcgatatgaacaacgactgggtgatgttccgttattccgaggttatctataacaaagcggaggccttgatgcgtaagaacgggggcaaagcaacgcaagaagtggtagatatgatcaacagcgttcgtcaacgttctttcaaggcagaggattgggagaaagcgaaatatacgaccgctacattgacaatggatgagttcttagccgaaaaaggtagagagtttgctttcgaaggaatccgccgtacagacttggttcgttttaacaagttcgtaaccacttcttggtgggacaagactgcatccaacgaaccaaagcgtaatatcttccctattccgcaaagacaattggatgctaacgcaaacttatctccgaacgaggctaactcattgttctaaatatcaactaagtatagtagaaattcattattaacaaattagcacttgacaatgatagaggactactatacttattgatctgaaaatataaaaggttacctttgtcactatcaaaggttatccttggaactatcaaaggtgaccttttatgtttcatccttttctaactaattgatacgacatgataaatctcaagaaatcgatgtgttgcctctttctggcagccagctcaacagtagcgatcgcacagaccagtgtagttgatcttgtaaacccgatcatcgggacgaatggaatgggacatacgttcccgggtgcttgcgtacccttcggactcgtacaactcagtccggatacggataccataccacacaacgtagatggtaaataccaacctcgctcctacgagtattgtgcgggttatcaacataaagacagtagcatcgtaggtttcagccacacccacttcagcggtaccggccactccgacctcggggatatcttgattatgcctaccaccggaacgttgaagctaaaccccggaacggccacgaatcccgatggcggttaccgttcccgtttctcgcatggcaccgagatatcccgtcccggatactacgaggtgatgctcgccgattatggcgtaaaggcgcaactaaccaccacccaacgggtcggcatccacaaatacacataccctacgaacagtgagaaccaacgcattatccttgatatgattcacgggatctataactatgacggcaaagttctttggaccaatattcgcgtagagaacgatacgctggtaaccggctatcgtatcacaaacggttgggcacgtaccaactatacttatttcgccatgtctttctccaaaccgatcacgcattacggatgcgaagagaaagcgaaagttaattatcggggcggttatgccaagttcaatatgaaagagaacttcccggatatcggaggacgtaagatcgtcgcttattttgatttcgatccgaaaacgtctgatgagttggaagtgaaagtcgccctttccggagtcagcaccgagggagccttgaaaaatctacgtgccgaggcttccggtgcggacttcgaccaattagccgccaaagcctccgatacttggaataaagcgctctccgtcatcgacgcgaaaggaagcgatgatcaattggctatgctttacacctccttgtatcacacgatgatcaatccttgcgtatatacggacgttgacggtcaataccgcggactcgaccataatatccatcaagcggacggattcacgaactatacggttttttccgtatgggatacctatcgtgccctacatcccctgttcaatatcatcaaccgacaagttaacacggatatcgccaaatctatgttgaaacattgcgagcaaagcgttcatcatgccttgccgatctggagccatatggcaaacgagaactggtgcatgatcggttatcattccgtctctgtcttggcagatgctatcgccaaaggattaccgatcgataaagacgccgcgttaaaagcgatgatcaacagctctacgattccgtattatgagggaaccaaagagtttatggaattaggttatgttcctttagatcgcaacggtagcgcaggctccttgactttggagtatgcttatgatgattggacaatctataatacagctttattagtgggaaaccgatccgtggccgatacctataaaaagcgtgcgtccaattacgcgaatgtattcgatacctcgatcggatatgcccgtccccgttatacgaatggtaaattcaaagaggacttcagtttgttaagcacgcacggtgaagggtttatcgagggaaatgccttgaattattccttctatgtccctcaagatgtcaatggtatgattcagttgatgggaggcgagcaagcattcatcactaaaatggattccttattcacgatgcatcttcccgatgagttctttgccgagaccgaagacgtaaccaaagaaggattactaggaggttatgtacacggtaacgaacccagccatcacatcccattcttatacgcatggaccagccagccttggaaaacccaattctggcaacgcgagatcatgaataagatgtatcgcaacaatatcgacggcctttgcggtaacgacgactgcggccagatgtccgcttggtatatcctttccgccatgggattctatccggtttgcccgggtacagatcaatacgtattaggcgctccttaccttccctatatgaaggtccgcttggagaatggtaagactttcgaggtaaaagccgataaagtcagcgacaagaaccgttatgtaaaagcggtaaagctaaacgggaaaccctataccaaaggatacatcacgcaggatgacatcatgaacggtggaacgctcactttcgagatgacttccagcccgaacaaaaagcgattgttcaacggagaggatcgcccttattcactgacggattaacccattttatcagaaaaaacagacaagactcatgaagtataaacaattaatcagcggtgctttcctgctgtggacttgcatcgcttgctccggcaaaaaggaacaggcggctacagtagcggaagccacctcaaatccttgggataattattacatcggaaagatcgatttcaagaatctttcccccgaggctaagggctcggcaatctatgccgccgttatccctgatccggaagcttatattaccaagcacgcccgcaaggtcgtagagacgctttatttcactccggaagatagtatcccgggcatcgaggagatccactatacattaaaggaatacgacggggtatccgcgaaagacggagcgcccccttccatcagtatcgtatacagcacgaaatggatcgagaaaagttttgccaataacgacactgcgaaagtggattacgagacccgtggcgtattataccatgagctgacgcatggtttccaattggagcctcaaggcataggtagctatgggactaataagactttctgggccatgatagaaggtgtggcggatgccgtaagatacttaaacggcggttttaccttggaagatcgtcccaaaggcggccattatatggatggttaccgcacgacaggcttcttcctcgcatggcttacgcaaaccaagagcccggatttcctgcggaagttcaaccgaagcacattagaggttattccttggtcgttcgatggtggcgtgaaatatgcgctcggcaatgattacgacatagactccttatggaaagaatatatggcaacgatgggagatgaagcgtagccccggcaaaggctacgaccaacggcggtaacactcaacaagttaccgccgttcttttatagtatcactcccgaccttccgccaataggcattataaggtcgcaacaatgcccatcgtaagctccttatactgcccatcctaacaaccttacaatgggcattgttacattattcccctaaaacaccttccttatttgcatttccgtaaacatatatctacttttgcgaaaaagtaaatatggaactttatacccgaatcctgttgccgaaagcacgattctctttctcgtatgaggaccgggtcgtgatgatgggctcctgcttcgccgagaatatcgggcggaaactggaagagaataaattctccgtagatataaacccattcggtactctgtataacccggcttccgtagcggaaggattgcggatgctgctacgcccggagtatttcactcccggcgatttattccagcatgagggcatataccatagttttacccatcatagccgtttctccgctccctcggaagaagaatgcctaggccatataaacagccgcttatccgaatcctccgatttcctgcgaaaagcgacccggttggtaatcacgttgggaaccgctttcgtctaccgcctcaagagcgacgggcgaatcgtgtcgaattgccataagctaccggaaaagatgttcgatcggcaacgattatccacgcaagagatcgtcgaggactggaaacctctgttactagccctttgggaacaaaaccccgccttgaaaatcttatttaccgtaagtccaatccgccactggaaagacggggcgcacgagaaccaactcagcaaagccaccctattgctagccacggacgccttacagaaagattatcccggccgaatcgcctacttccccgcttatgagatccttatggacgagctccgggattatcgtttctatgcggacgatatgctccatccctccccattggccattgattatatttggcaacgttttatcgaaaatttcttatccacagacacttcggcaatccttaaagaatggggtgatattcaaaaagctattaaccataagccctttcaaccggatagcgaggcctataagcggtttatccttcaaactttgttaaagatggaacgaattagcgagaaaattccttcctttgatatcagaaaagagatcgaaatagtaaagtctaaactaaaataaaagaatggaatacgcaattaaagaaatagcaagagttatcggtgctaaaacaaaccaattgcttgacgatacggtcagtttattgttgactgacagccgtcgtctctccttcccggaaaaaagcctcttcttcgccttgaaaaccaagacgaacgacggacatagatatatacaggaactctataaacttcgtgttcgcaacttcgtggtaagcgatatgctaccggagttcgagagcatgaaggacgcaaacttcctgatcgtaaaagatacgttacgagctttacaaaaactggcgactcaccacaggaagcaattcaacatccccgtgatcggcatcaccggtagcaacggaaagacgatcgtaaaggaattcctctatcaactgttgcataacgagttcaacatcgtacgttcgcctcggagctacaactcccagttgggggttcctctctcggtatggcagatgagcgagaaaaatacactgggcatcttcgaggccggtatctcacaaccggacgagatggaacgcctgcaacccattatcgcccccacgatcggtatcatcacgaatatcggggaggctcatcaagagaatttcctctcctccaatcagaaatgtatggagaagctgacgcttttcaatgattgcgaagccattatttatgatggggatgatttatttatcgccaattgtatcgaatcggcttgcctttctcataaagcgatcgcatggagccgtacggactccgaggctcctttgtttatcgagtctatcgataagaaagagtttgagacgatcattcactgtactttactgggcttcaaccgggtcgttaccattccgttcacggacgacgcttctatcgagaacgtgatccattgtatggcggttatgctttacctaaaacccaccagcgtaaacgacgtaacaaaattcttgcatcttgagccggtggctatgcgattggacgtaaagcaaggtatcaacaattgcctgttgataaatgatacctataactcggatatcaactccttggatatcgcgctcgatttccaacaaagccgccgggtaggcaagcaattaaagagcactttaatcctctccgatatccttcaatcgggcaccttgccgaaatctctatataagaaggtcgccgatttggttcgccgtaagaagatagatcgtatcatcggtatcggccgcgacttaaaggaatatgcttccgtcttcgagatcgagaaggagttttacacgaccaccgaggaatttatcaagtctccttccttcaagaaattcaaggatgagttgatcttgattaaaggttcccgccatttccatttcgagcagatctccgagttgttggagaagaaagtgcatgagacgatcctagaggtaaatctggacgcgatcgtacacaacttcaatcagtatcgttccaagctaaagccggagactaagatggtttgtatggtaaaagcttttggttatggagccggctcttacgagttggcgaagacccttcaagaacatcgttgcgactatctggccgtggcggtagccgacgagggagccgaattgcgtaaagaaggcatctcgatccccattatcgtcatgaatccggaattcagcagtttcaatgtcttgttcgagaaccatctggaaccggaagtctatagcttccgcctattggatgccatgatccgggagaccgagcgcagagggatcacctcttaccctatccatatcaagatcgataccggcatgcatcgcctagggtttcaaccggaggatgtcccggcgatctgtgaacgcttgagagcgcaatccggggttatcgcccgttcggtcttctctcatttagccggaagcgactcgtacgtcttcgatgattttacccatcaacaattggataaattcaccaaagccgcaggggaactagaaagcgggttagagtataaggtaatcaaacatatcctaaactccgcgggaatcgagcgtttcgccgcttatcaaatggatatggtacgtttaggtatcggtttatatggagtaagcgcatccggacaaaaaggcttacggaatgtcagcaccttgaagacaacgatcttacaaatacaaaacgtacccgcaggggattcgatcggttatagccgtatgagttatgtgaaacgtgattcccggatcgctatcatcccgatcggatacgccgacggactggatcgccacttcagcaacggaggtggggaggtcttgatcaatggacaacgctgtccgattatcggcaacatctgcatggacgcttgcatgatcgatgtcaccgacatccatgcgcaagaaggcgacgccgtaattattttcggcgacgaactaccggtgagcgaactttcggataaactgaaaacaatcccttatgagatattaacctctatctcgcctcgggtaaagagggtttatttccgggaataagaagtaaccgccaacaaagaatggctctaccttgttttaatatcaaggcacatattcaaatgtcaggctatgatattcatttgcgtatgttgcacattttgtgtatgtttgtgccgtaattaataaacaagaggtatgagtcataatttattgaaaggcaagagaggcattatcttcggtgcgctgaacgatatgtctatcgcctggaaagtggcagaaagagccgtagaggaaggtgcgactatcacgttaagcaatacgcctatcgctgttcgtatgggtcaggtagatgctttggcggagaagttgaatgcgcaggtaatcccggcggacgcaaccagcgtagaggatctggagaccgtattcgcgaagtcagtggaaatattaggtggtaaaatagatttcgttttacattctatcggtatgagcccgaacgtacgcaagaaacgtacgtacgatgatctggactatggaatgctggaaaagacgttggatatctccgctatttctttccacaagatgctacaggtagcaaagaaacaagacgctatcgccgagaatggttccgtggtggcattaagttacgtggccgcccagcgcacgttcttcggatacaacgatatggcggacgctaagagcctgttggaatctatcgcccgtagtttcggttacatctatggccgtgagaaaggcgtacgtgtgaacacgatctcccaatccccgacaatgacaaccgcgggtagcggcgtgaagggaatggaacacttgatggacttttctaacaagatgagtccactgggtaacgccaacgccgacgagtgcgcggactattgcgtaatgatgttctccgactttacccgcaaggtaacgatgcagaacctataccacgacggtggtttctcaagcatgggtatgagcctccgggccatgaaccaatatagtaaaggattagaggaatatacagacgagaacggacacattatctacggctaatatgttagtgagaatctatccggagaatccgaatcaaaaagaaatagacaaggtcgtcaaagtcctgcaggacggcggccttgtcgtttatcctaccgacacggtatacgccatcggttgcgatgcgctgaacgtacgtgcggtagagaaaatatgtcagatgaaaggggttaatccacagaaaagcaacctgtctatcatctgctacgacctgtctaatcttagtgaatacgccaaggtaagcaacgccgctttcaagctgatgaagaaacatctgcccggtcctttcacctttatcttacccaccagcagcgagcttccaaagatttacaagaaccggaaagaagtcggaatccgtgtaccggacaataacatcacccgtacattggtacaatccttgggaaatccaatcctaaccatgtccatccgtgacaaggatgaggtgatcgaatatacgacagatccggaattgatacacgagaaatacgagcatcaagtggatatcgtaatcgacggcggtttcggaggattggaagcctctacggttatagattgcacgacggataatttcgagatcgtacgtcaaggcaaaggagaattgtagctatccaccacgatttgtattcgctcttccggcagattagcgggaaactccaagcttatttcttgttggtcacccggcattagcgtaatatagttatccgaataatgtaccggtaagattcgtttgcctgtctccttatcaaagaccttgatacggttgaagaacgagatctgcgaatcagcgctcagacggactgtacctacgaaattcgatccttccttcttgatctcggtcttgattcccggtcttgacttcggaagttgagataagctggtgtagtctttcggctcggttgtcagccaataaatattggggacatccgcattcaaggccagccgtaagaaataagcgcctttgatcccttccggaacggggatatccaataattcctgtaccgtattcgccttggcgctcgctctcgtctctttctcccaaagcagtttgccttccagattatagatacgggctacaatcgataaatccgtataatctttcagggtcgtattcaacaatcccgccttacgggttaccgggttataataggcatgtaagggctcacagcctttccgggttccgtacaaggaagcatttacatcgagagaccaatcatacatttgcccccgcaaggatgtccatggattctgggttttccagatcaagatacccgtataccaatcccacatatgagaggcccagccttccataaaactacgatattggtcatagttcacgacttgggcatacttacaataagtctcgatatccttcacctccccataacgctccagatgatcgccatagcccagatccttatgataccgccacgtataattacgggtcaaacctttccttgggaaaccggccaaatcctgttccgtcatcatctcccgcatactctcgacctccggggaaccaaccgatccggcttccggattaaacggatgcgaacggaagctaaagaaccattccggctcttgtataccgtaaggaccatccccattatcccccaaaaaattccgggtaaacaacgtatctgtcgagaaactcacgaaaagacgctccggatctaaccgggggaaaacctcctttctcaaacattgatcgatatctttagctaaaggccattcattcgccccacaccagaaacaaagactcggatggttacggatcattttcacttgatcttccacggaggcgataaataaatcatgattatcgggatattcccaacgacgctctcgggaatccatcttggtcgggtcctcccaagcgccattgcaatcaccactgccccacagatcttgaaagactaagataccgaactcatcacaggcgttatagaattccggccgttccaccaacgcacctccccatacacggatcatacgcagattcatttccgcatggaaacgtacctcatcccgataacgttccggagagagacgaagcaaccaatcggaattaatatagttaccacccgtgacatatattttctgtccgttcacgaagaaacggcgtcccccgttatccgggcatttatcggaagtaatctcccggataccataacgcaaccgttcccggtcactcacttgattcccgatctcaaaagagaggttcatatcatataaaggctgctcgccgataccgttaggccaccataaacgaggattctttaccgctaaaggattcaaggataccgttttcttctcgaatggcgataaagtaaccggctgggttaagcgggttccgttcgtctcacaaaccaatagcccctttaaggaagtgctcccggtattctctagctcgacagaggtattcacaaaagcctccttttgagttttcgtttccggatcacgtacgccgggtaccttggtcacgacataaggagaggagaggcataccggcccggttgtcgtaatagatacctcatcccaaatacccgtattccggtctcgtacaggttgtatccagtcccaacccggcgtatattgcatcgtattattccgggcgatctgcccatcacccccttgtccgccatttggatttccgacatgtgtaggtggataaaccaataccgctaatacattcggggcatccgtacgaagataaggagttatattaaacgtcttcctcaagaacataccctcatgggtattccggttgatccgcttaccatttaaaaagatttccgccttataattgattccccggaaattcaaccagacattacgcccctctggtaaagcatcgatagtaaactgacgggtaaaccaatacgtatagaaatcattgccgacttcatgtatatcgggaatcaaattgttattcaacccaaactcaggggccggatacaaaccattctccaaaagcgttgtcaacaccgtacccggtacacgagccggtaaccatcctgttttatccaaaggcaccgcgctcaaccggttcccatccattttcacctcattcgctttccgggcataccaatctgagtgaatcaaggttttctctcccgattccgggatcaccaacaaggcttgcccctccgcggatacgggctttgaccagcaagccaggcaaagccaacaaaataaataaatacatctgttcatcatataatcttagatttatccttctaaagtagtacaaaattcagaagggcctcttcgcaaactcgaagaagccctttcattacatattatttaacaataagacctattaatgccgattagaaattacctacaccagctttgtcccaccatacatgagtaccacctttatcaccagagatcgaacccgtattctcttgattcagcagctcgatgcctttctgtaattccgcattattggtgttaatttccgtatctgagtagatcaagcgacgaacttgttcgttagtattgatatcaccgttactcaagtttacacgattcgggaataatttaggatagcctgtacgacggtattcagcccaagcctcacaagacaatgggaagttagcgatccatttctgagtaatgatacgttgcaacttctcctccttactagcaccttcgtcccatttaacacctagtgtattcatcgcctttatactattttccgccttaaccgggtcaacaaagtcaatctgtccactggttccattgagataagcgtctatttccgcatctgagatagaagttacacctgcaatactgcccttataagccaattcgttcttgatagaaatacgaatgccctcctcatatagatctttagcgctacctcccatgctccagccacgtaaagcaccttcagcacgtaaaaaataaccctcagcaactttcatgacagggaaagcggtcgtataagtgcaaatcactttagagaaattaccccattgatttggcttagaaggtaagttacatccgccgcgaacaccaagatactttgtcccctcctcaattgtcgagccatcttcacaagtaacagccgcttgattcttggtcacatacaaaggtaaacgaggatctttgaaaccttccaacatcgtgattaagctagcattcattccacaatcaccccactcaaacatacgagtcaactcattgctcaaaccttggttgatcaagatatcacgatcagcggaagtcaatacgcctccttgaacggcttcctccgctttttgcttcgccaatgtagggttcacctttacgatacgcatagccaaacgtagtttcaattgattagcgaccttcttccacaaagcgatatcaccattacaccaatagtcaaatgcttgcatatccgcaacagatgcagttcccttaaatccagcgatcgcttcatccaccaaagtaaacaaagcattgtagacactttcctgagtatcataagagaaagaagctccacccgtaggatcttcgataacagaactataggccactgggccataggcatccgtcaacatctggatcgcataagcttgtacgacacgcatcatcgctccataatcacttaagccttgctcatcacaagaagcaatcagacgacgggtattgttgaaaatatgaagatatacattctcatacataccaccacagaaaccacggttcaacgcataatcaacattaccggaaccattaaagttatgtggagtcatgaagtagccgctaaacaaatcaatatttaggttgaagcaatattggaacaagttctgctgcggagcatagacataagagaatggctccttaaattgggcagagaacggaagttcatctggatcaacctcatagggatcagtatttaaattttcaaaattatctgtacagcccatggtcataacaccggtagatactaccaaagccgatacagcggcatattttaaaattctatttagtttcataagatatactcaagatttagaaattaagttttaaattcaaaccaaagctacgagatgttggcaacgcaaacatatccacaccttgccagccattgcctgtaccagccgctacatccggatccataggagcatctttatagaagaagaacaaattacgtccaatgatagaagccgtcaaattcttattcgctccaaataagttacggaacgtataaccaaatgacaactcacgcaaacgaacattagtcgcattgtaaacatactgagaagtcaagatattagagttataacttgtacctccagtcgtcgtgtaatatgctttaggatcaaatgaaacaccatcaatcacaacttcacctgcatcacgagcggcacccgaacgctctgatacgccccaaccatccaaggtagcttccgtcattgacaagaccttaccaccgaccttagcatcaatcaagaatgacaatgtaaaatctttgtaatggaacgtgttagtccaacccatgtttacttttgcgttcatatcaccgacatataccaaatccttattatccgtacctcccaactcaggagcgccagattcagttttcaccggcttaccattatcgtctctcttgaaatcacgaacatataagtcaccaaaatgaccaccttcagtcaaaatcactttcgcacctgtacaatagctagctaatgtccaatctttcaactcattcgataattcaatgattttattattattgtaagagaaattgaaattcgtactccagctgaaattgtccgtaaactgattataccaacctaagctaacctcaaaaccttggttttctacgttaccggcattgatataacggttcttcaaaccagtttcccaaggagcggtaatattaaaatattgattcttcgtattggtcttataatacgtcaagtttacattgaaacgattctggaagaaagttccatcaaaaccaacctctaaagagttcgtcttctctggcttcaacgttctaaaagcagcttcttctggcgggtcgatagatccttggtcaccaatcgtataacgtttattggaagcatagataggcacatcgttacccacgatagaataagaagcacgcaatttaaataggtctacattctttccaaagtccaagaatttatccaatagagcacttacaccaacagacgggtagaaaaaggatacaccatccgtaaacgccaatgaagaagaccagtcgttacgagcgctgacatccaagaacaaaccttccttatatccaaactgagcagtagcgaacacagagttcaagcgtttttctttcagagtctctgtggtttgcatcgtataatagttcttcggggagaagatgttcggataataagcacccggggttatcacaccgttatttactttaaactccttatcaccccaaccgatcaattcgatgctagatgcgcttgtcttcgtaaagctaccaccagcagtaacggacaatgaataagtctcatcccaagttttattataacttgctaacgcatcggcatatgtttgctcactgaaagtccgggtatctttcatggtacccaataaatttcgtcccgcggtactagacgcatattcgttcaagatccatttttcatcaccacgttcataacgcaaacgccccgtaacagaaagaccttccatgatatcatatttaacactaccaccaaattcataacggttacggtccgtgataggagtctgacgattcaacatccagtaaggattggagaattgctcttgtttcgtattcgtccagttatgaacattcacgttacgaaccccgtcatatacttcatagttactcttgtagtaatcccaatcctcacctctcgggaacaggtaggcacctgtaatcgggttattcaaataaccggcagaaggctgattctcgatatgctgcttgttgtagcgggcacttacatccacatgtactttcttccacaagttaaagccaaccttagccattaaattatgacttaaataatcattctccggcataataccattcgatgagacattcgcgtaagagaaataagaagaaatattctccgttccaccagataaagagatagagttattcgttgtataacccggttgatagaatttacgtgcgtaattcggagatgtagctcctaatttacttccccagctaaatgtgccctcgtcactcataccataattattttggaatttcggcaaagacatggctgattcgaccgtcgtattactagatacattaatagcgaccttaccggcttgtgcggattttgtcgtaatcatgatagcaccattggccgctaccgcaccatacaaagcagcggcggaagcacctttcaacaatgtaatctgcgcgatatcatccggattgatagtagacatagcgtcaccaccatcacgttcgccgccataggccatcttcacctgcgaatcagatacgctcatcatcatagggacaccatccacaacaatcaacggttggttactaccgctaatagacttattaccacggaataagatcttagaagaaccacccgcacccgtagagttcggggtaatctgcaaaccagcgctctttccttgtaaagagttgatcatattcacattcttaatctcgttcaagtccttaccgcctaccgtttgtgcggaataagtcaaagtctttgattcacgtttgatacccatcgctgttacgacaacctcatccaaagcctctgcgtctgaaaccatcgtaacatcgattttcgtacggccattcactggctcctcaatcgttttcatactcaaataagagaataccaaaatagagtttgcgtcagcctctaaggtatattttccatcaaaatcagtaatggtaccggttgtagtaccttttactaacacgttcactcctgttagtggttcatttagatccttgtcaatgacgacaccactaatcgttagtttctgtgcatatcctgtaacacacagaaaaaacgccaataataagataaatgactttctcatgaaaaatcgtttttgatttaagtgattctacatttgtgcttttttaattttcatactctttttagagagatcgggctctcttttctttcttttttagtgcataggcatttactcttttttgtttaaagttattattatattcatacaaaaatctctttctatttaaaatcaaacggttatattttaaataataataacaacgtagtatcattagaactaaatcaaattaacatatttaatttattgaggcatgatgaaaatttgactatgtgttatcgcaaacacctgaaaaagtgaggaacatactgatttttgttacgttttaacttgtatgtatagttattatatatatatttgtctgtcaaaacatgaaaacgacttagttctaatgaaactaacaacaaatttcaattaacataattttccttcattatcttcttcctcctataacatccaatcgctatctgactatcatcttggaataaaattacagctttatttacaagcttcgaaaacaactcagtcaggaaattaaccattaactctaatttcttccacaaatattcaatgatttgcacagattatctctacatttgcgatatatatatatatatatattaatgtattgactatgaactggacccagctattatccggcaagcgtttcggaatggaagagtatcacgagcggaaacatgagagaactgatttccaacgtgactatgaccgtttgattttctcatccccttttcgaagactacaaaacaagacacaggtgttcccccttccgggaagtatctttgtacataaccgacttacacatagtctggaagtatcatgcgtaggacgttcattgggtaataacgtagcgaaaggacttatgcaaaaatatccggacggcagtatcaacttcccagagataggttccatcgtatcagccgcttgccttgcccatgatatgggaaaccctccattcgggcattccggagagagagcgatctccgcttacttctccgaagggaatgggcgaaaactagaagagaaagtacggaaggaacggggacgctgggaagacttcgtccattttgaaggtaacgcaaacgccatgcggttgttgacccatcagttcattggacgcagaaaagggggatttgccttaacatatagcacattagcctctatcatcaaatatccttacgcatccatctattcaggaaagaaagggaaattcggctttttccaatcggaggagggaagttatctgcaaatcgcccaagagctagggatcggacatagcccggaagccccagacaaatttcttcgttacccgttagtttatttagtagaggcggcagacgatatctgctatcaaataatggatatagaagatgcttgcaaactgcatatcctgaccaccgaagaggccatacagctattattgggatttttcgaaggagagcggttggagcatatccgcaaggtcatgcatatggtagacgataccaatgagcaaatcgcctatctgcgttcttgtattatcgggctattagtggatgaatgttcccgtgtctttttagagaacgaggaaagcatcctcaatggtacctacagcactccgttaatcagtaacatatgcgatcaagccaaacaggcttacgctaattgctcggctacagcatacaagaaaatatataaggcaaaagaagtgctcgacattgaattagccggttatcatattttcagccatctgatcgacagcttgaccgaggccgtgatgaaccaagagcatgcttacagcaaactgctcttacaacggataccggagcaatacgacacaaacgctcctactacatatggcaagatacaatgcgtactcgattatatctccggcatgaccgatgtatatgcgctcgatctataccgtaaaatcaccggtatgagcctgccggccgtttgatgttataataatgtgttagaattcttcccggtacttgctttccatgcgatcatccaagatacttagatagcttttatagcgggactcgctgattagcccatcgttaacggcctgaatgacggcgcagcccggttcatgacggtgcgtgcagttattgaaacggcattcttccgagtatttaaacaactcccggaaataatgggagatctcagcgtccgccatctcgatcgttccaaatcctttgatacccggagtatcgatcaaatagcctcccccgggaagaggaatcatctcggaaaaggtggtcgtatgcatacctttgttatgatattcggagatatcaccggtacggagattcacccccggcaccagtttattgataatcgtggattttccgacacccgaatggccggacaaaagcgtaatcttatcttttagatccgctttcaaggcatccaaaccttcctcggtccgggcacatagcgtcgaacagggatagccaatcgaggtatacaactcgattaaattctccaacgccctttgatcctcattattataacgatcaatcttattgaaaactaatttaacagggacacgataagcctcggcggtcgccaagaagcgatcgataaatatcgttgttgttataggataattcaccgtaacgatcagcatcgcctgatccaaattcgtggcgataatatgcgcttgcttcgataagttagaggcacggcggatgatataattcttacgctcctcgatctctgtaataaaagcggttccttctttattaatatcgattacgacacggtctcctaccgcgaccggattggtactctttatgtctttcagacgaaagttccccttgatcttactctctatatctcgcccgtcttccgtacggaccgtataccaactacctgtgttttttattaccagtcccctcatgagaattgaaaattgagaattggaaattgagaattggaataaggactcaatggggttccttaattctcaattctcaagtttcaactttcaattatttaaacggtcattacttctttttctttagcggcgtaaagctcatcgatctttttgataaacttatcatggattttctgaacctctgcctcggcgtctttctctacgtcctcgggaaccccatcagacttgatgcttttcttcaaagcctcaatagcgtcacgacgagcgttacgaacgctgatcttcgcgttctccgcctcctgcttacattgtttcaccaattgacggcgacgctcctcagtcaacggaggaatacctaagcggatcacctcaccgttattctccggcgtgatacctaactcagaatccagaatacctttctcaatatcgcggatgatcttcttctcccacggagtgatcatgatagtccgtgcgtccggaaccgtcaccgtagccacgttagtaagaggaacaggcgccccataatacattaccttcacacaatcgaggattttcggattagccttaccagcccgaatgtgagacaattgctcgtccagatactcaatggcgaacgtcatcttctcttcccctgctttgatcaattgtttcgtatctatcataaatatacgttttttgtttgcgaatcttttaattaacaaaagtaataaagatttccaacttcgcaaacatataattaaaatactccctaacaaaagatttataataccgtataaaagcttatcgccgtcactgtttacttaacttaggcgtaaagaatagtaagtaggctacgcccacgcacaacaccagcactgctcctacttgagaagccaacatatcggatgccacgcccataaagatcgggaagatcgtgccgccaaacagtcccataatcatcaaaccggacacctcattctgcttattcggcatagaaagcagggcttgggcgaaaataatggagaagacgttcgagtttccaaagccgatcaaggcgatacaagcatagatgatctctttcgaatgaaatagcagcaaaccgatcatcgccaataacatcaagaaaacactaaaggcgaagaatcctttcggagagacttttcgcaagataaaagccccggagaagcatcccgccgtacggaatatgaaatagaggctcgtggcgaagcctgcgtcggccaacgtcatgcctagacgttccatcaagatcttcggggcggtcgtattcgtccctacatcgatccccacatggcacatgataccgataaagcaaagcaggataaaaggcttgcccagcaaagccagacattcgccaaaggtggagggccgcccctcctctttggtctcgtggatagtggtagctcccaatagcaggatagcgatcacggcgatcaccatatagaccggaaacaagacacgccaaccgagttccatcgacggtatcgcttgggtagcaccccacatggcgatataaggcgccaagaaggaggcgatcgccttcacgaactggccaaacgtcaaggaactagctagcttatccccgcttacgatattcgataataacgggttcaaggaagtctgcatcaaagcgttgccgatacccaacagggagaaggatatcaacatgaccatatatgcgtcgtcgaagatcgggatcattagcgaaagaaacgttacgatcaagctcaataacacggtcttcttccgcccgatacggttcatcaacatccccgtcgggacggagaagatcaagaaccagaagaacacgagcgacgggaagatattcgcctccgaatcactcaagcctaaatccgctttcaggtaattagaggcgattcccactaagtccacgaatcccatggcgaagaacgccaacatcacgggaatcaatttcaaggatgaagtcttctcgctcatggcttataaatctttagggtaagcaggccatgcgccactctgcgtacaaacataagcggctacttttaccgctttctcatgtgcctcacgtaaaggttttccggttaagatcgatgaaataaacgccccggagaaagaatcgccggcgcctaccgtatctaccacctgtaccttcggggtaggaatcgtagagacctcctcctcggaaaagatcgtactatactccgccccggccgtaagtaccaaatagcgcaaaccatatttcttcatgaaccagcgacacatatcctctatcgtgccttccagaccaaacatcgggcgaagcatttccaattcctcatcattgatcttgaatacgttcgccaattcgagcaacgattcgatcaattccttcgaatagaaatgctgacggatattgatatcgaaaaagcgcaaggcatgactaggcatataagaaagtaaggtacgaagcgtctcacgagattccgcggcacgttgcgccaatgttccgaagcatacggcgtccgcacgtttcatcaaatcgatagacgcttgggtaaaagggatatgatcccatgccacaccttcgatgatcgtataggaagggatgccgttctttagctctaccatcacgcttccggtcggatattccaccgtactgatataattactatcgataccgttcttatccaattcctgaataatctcggttccgaacacgtcgttgcccacggcactgatcgcataaccttccgctcctaattgggtagcgtgatacacaaaattaatcggcgctccaccggctttcttcacttccgggaaaacatcccacaacaattcaccaatgcctactactacaggtttactcttttccatgatatattttgtttttaattatttgaagggataaatggttaatgacgtaaccgtgaacgctcctcccttcgcattgaagctaatgcgattatacggctcttccgggaagactaggttggtcatgacaaactctccattcccgtcgaaggcctctatgctacaattgtctaccaacaaacgtaaggtatattccttagcggcggagatcggggccgaggtagccgtggcgaatgtcttgctaaaatccgtagccccgctgttacggcgatccatcgtgaacgtattatccagaagattataatgcatctccacttcctcacctttcgagttaaacaactggaaactcatgatatcggctccgttattcttaaacttgatctcgatctcataggttcccgtatgatcggaaagtatcggattgacctcatgggaacggtctaccttgaaggttcctttcttctgggctttacctctcaatttcaacatttcgggagacggggtactgctcaaatacgtctgtccgtttttcgtataaagagccaagtcgcgaggaaccgagttcgcgctccggtattgcaaggtcggcacgttattcgcatattcccaattgctcatccaagccaaggcgatcttccggtcctccggagcgttactccaagttaccgtagcgtaatgatccttgccgtaatccatccatttggtcaaggccggagattcattcacgaactgtttcccatcgaacgtacctacgaaatattgggtagcggagccgccaaacggaccgccgggattgatattacagatcaagacccacttcttcaattccgtacccttcaccggaagctcgatcaagtccgggcattcccaaacgcccgcatgcgctccttgtccttccccgaagctgctctcatacgtccagtccttcaaattgggagaagaatagagttgcatctcctgccctacggcgagcaccatgatccatttattggattccttatgccagaagactttcgggtcgcggaaatcacgttgcgtagaagtaaggatcggattccggtcatatttcttgaacgtccggccgttgtccaagctataggccatactctgcacttgccggtcgctggccgaggtatagaaagccacgatagcgccagcgccaaaaccggcggtattatccttatccaccacacagctaccgctgaagatcgtacccaaggcatccggagcgatcgccaccggttgatgctcccaatgaatcaagtccttgctgatcgcatgcccccagtgcatattcccccacatcgagccatacggattgtattgatagaacaaatgatactcaccatccttgtataccatgccgttcggatcattcatccatccccaagccggcgagaaatgataggccggacggaatttctcccggttagacgaatcaaactgatcggatagcttcatctctttccagcaaagagccgattccggggcaagctggaagttgaaggagatatgcttatccgcataccctgatagatctaccggaacgaaataatccaccttattcaccgccaaacgaacattaaaagtccgtaccacgtcattatcgacaatcatatataacttggattccggcgaggactcctcgaccggaagcaacaaatacttggcttgcgcatccacacggacaatgctttgtccttcgcccagatgctttatatctatagtacgttctgtcgcatatccggccaacggatcgacagcgcttaataaaacgacaccgacagccatacataaactcttaagaagtctctttgtttgttgtttcataaacgaacggattaaaggataataatgtttgattctccgccaaaattaataggattcttccggatagaaaaacacttatgccctaaagatggggagatatgacatttgtgataaagatcgtacaaatgttattgatactcggtaggcgtaaccccgtaaaccgccttgaaacatttagagaagtaagcgggtgaggagaaaccggttcggtaagcgacctcactcaccgtatacgcattctgcctcaacaactgggtcgccttattcaagcgataggtacgcaagaactcgacgggggcggttccggtaagctccttgatcttccggtgaaggtgtccccgggataatcccaaggtctcgcttagtttctccacattatattcggggtccgcataaaccgcctcgatctgttccgcaaacttacgcagaaaggcatcatcgatgctctccaccttttccggctcggacagaaggagcttattatcccgcagcttctccaacaaacgttcccgtaacttctggcgctcttgcaataggtggataatcttgatcttcacgtaatccgtatggaaaggcttctgtatataatcgtccgccccgcaggtaatcccgaaaatccgttgacgctcatcggtcaaggcggtcaataagatcaccgggatatggctaaagagaagttgcgacttgatcgtccggcaaagttcgaaaccattcatctccggcatcatcacatcgcttactaccaatgatatctcctcctcttccaatacccgcaaggcatctttcccgtttgcggccgtccggatcttgaaatgaaggctaagctcacgctccagaaacccgcggacctcatcgtcatcctcggtgatcagtatcgtataaggataggtcttggaaagtatctccttggtttccgaatcgtccaaccgggaggcttcgtaggcttgatgggatacggacgtttccatcaggtcgctatcctcgaaatgcgcctttcctttccgtaggcaaaccgtaaaggtagtcctttgtcccggctcgctcttcacatggatctcccctccatgcatatgtatatattcctttaccaattgtaatccgatcccggttcccatcgaccgatcctccgtatagaaacggtcaaacagatgcggaaggttaccgggttggataccacttcccgtatcgataacccgtataaagaccctatcttcctcttctgtcagctctatccgcacgctacctccctctggcgtaaacttaaaagcgttcgagagaagattgactaataccttctccaataagtccggatcaatccatagtgtacattgcttcatcgaagaagtgaatgtataagagatcgcacgtaccgagcccatactgtcaaaataagatttgatctcgccaacgaaaggaaccaaatcgatttcccgtaccgctagtttctcttgcttgccttccaccttccggaaatccaatatctgattgatcacacgcaacaaacggttggcgttcttctggatcagtcctagatccgaggcgtaaggagattcccgcaacgagacaatcaagcgatccaaaggggcgagaatcaaggtcaagggcgtacgtacctcgtgggagacattcgtaaagaattggagtttctgcgccgtcacctctttcatctccgcattcaaggagattagcttacgattcgcctgcctcatcttccggtttatgtaaaaggcataaatggaaagggcgataaaaccaatcatcaataaggagatcacccctaaagagtttcgcaggaaataaaaccggtcggacaaaccgtcgatacgggaacgctgcgcctcgatacgttgcttatatttctggagttggtccgcttgcaacaataaggtgcgggcagactgatgatctaccggagccgtacgaagagggataaacttatccaccggctccccctgaatgatacgcatagccgtgcgaatcacttgctcccctcctgtcggatagaggaaagaggcgttgatccgtccatcttctacggcttccagaccggcacccgccacagcatccacgccgataatccgcaaatcccgtcctcggatggaatcccatgccataaagtattcccgagctgctatggccatcatgtcgttatgggcgtaaacgaaatctatctgctcgggatgctctaacttccgaagctccatccgggccgtatcgaccagccattgtccttctatcttacggaaagaaagatcctccctttctcgcaaggcatcgacaaaacctttatgtcgctcttgcgccggggaggtttgcgtgagtccccatatctctaagataatagcgttcgggggaagataattggcggcgtaattgcctgccgctagtccgatctcataattgttcgccccgacaaaagaggtgtattgatcggtatttaccttgcgatctgtaatgatcgtcgggattccggcacggtacgcttcctcggcaactgccgtgatcggctcggattgatagggggagatgatcaagacatccaccttttggcggatcaagtctcgtatttgttgtatttgtgtctcgttattgttttgcgcgtcctttataataatttccatatcatcatagttagacgcttcgatacgcatatcgttaatcatagcttcccgccaagcatcgtccagcatacattgggagaggccgataacgtgcctcttctgtttccccgagctcgtgcaaccacacaatacgatcaaggttaaccatactagtaaaaagggatgcttcatatacaagaataaaggtctaacgtatttgccacagggctggcacaaccttgccatgcctgtggcacgacagtaccatacggatggcactgccatgtcatcggttaatggcactaattatgcaccagtgtcccgatattctctccgctcatcactttcttcaagttgccgttggtatccatatcgaatacgatgatcgggaggttgttctctttacacatcgtggtagcggtcaagtccattaccttcaggccccgggtatagatctcatcatacgtaatatcggagaacttggtagccgtaggatctttctccggatcagcggtgtaaataccgtccacacgggtacctttcagcatgacatccgcctcgatctcgatgcctctcaaagaagatccggtatccgtagtaaagaacggattacccgtaccgccggacatgattaccacgttgccttgttccagcaactcgatcgcacgccatttattatagaactcgccgatcggttccatacggatagccgtcagtaccttcgccttcacgccttgagcgaccaaagcggagctaagcgccaagctattgatcaccgttgccagcatccccatctggtctccttttacccggtcgaaacctttggaagcgccgctcaacccgcggaaaatattacctccaccgatcacgataccgatctgtacacccatctcggcgatctccttgatctgtgccgcatattcattcaagcgaacctcatcgatcccatattgtttaccacccatcagcgactccccgcttaattttaataagatacgtttgtattgagccatgttttgtatatatttaatatgtaattccgcaaaagtaacgaataatccgatattcgcataaaaaagatcgccccaaccggtgtcggggcgatctaaacactaatcccgtgttttgtaagctgcgaggattagctaaaattatatgaaacgttactggttactttttatctaagatctccaaggtatcggcagcgatcatgaattcctcatccgtaggaacgacgatgatagtcaccttactgtccggagtgctgattaccatctcctcgccacgcatgccctcgttcttctcaacatcgatcttcatgcccatgtattccatgttctcgcaaaccgcacgacgggtcgcccattggttctcaccgacaccaccggtccaaaccaagatatcacaaccacccatagcggcggcataagcgccgatatatttcttgatgcggtagttatatacgttcaaggtcatgatcgcacgcggatttccggcagctacggcagcctcgatctcacgcatatcggaagagattccggaaagaccggcaacaccacttctcttattgatcaagtcggaaaggccggcaccatccatgccttccttatccatgatgaaagacaaagcacccgcatccacgtcgccgcaacgagtacccatcaacagaccctcaaccggagtcaagcccatggaagtatccacgctcttaccattcttgatagcggtgatagaaccaccgttacctacgtgagccgtgataatcttctgatcctcataaggaacacctaagatctcgcaagcacgacgggatacatatcgatgactggttccgtggaagccataacgacgtacgccatatttcttgtacatctcgtaaggcaaaccatacatatacgcataatccggcatggtctggtggaaagccgtatcaaacaccgctacttgaggaatacccgggatcaaagcctccatcgcccgaacacccttcaagttagccgggttatgaagcggagccaaatcagagcactcgattaccttattgattacatcctgattgatcaatacgctagaggcgaactcctcaccaccatgtaccagacgatgacctacagcgtcgatctccttataatccttgatacaaccataagtagagtcggtcaatacgctcaagataaactcgataccttgttgatggccggggatctctctctcgataaccaccttcttgccatccttatccgtcaatttcaggaacgcgcccggcaaaccgattttctcgataccaccttgagccataacctcaccggaggtcatatcgaataacttatatttgatagaactactaccgcagttcaatactagaatcttcatattattaagtcgttaggattatatattattttgcggatttcaaaccgatggattgattacaagcgatcgctaccatcttataaatatcgtctacggaacaaccgcgagacaagtcattcaccggagcggccataccttgaaggataggaccgacagcctcagcgccacccaaacgttgaaccagcttataagcgatattacccacctccaaagtcgggaataccaaaacattcgctttaccggcgatctcgctacccggagctttcttgctacctacagcctcaaccaaagcggcgtcggcctgcaactctccgtcgatcttcaagtccggagccatctccttagccaaacgagtagcctccactaccttgtctaccatctcgtgagaagcgctacccttcgtagagaagctcaacatagccacacgaggctcaacgcctacgatattacgagccgtagcggcggtagcgacagcgatgctagccaactcttccgcgttcgggtttggcataaccgcacaatcggcaaataccaaaataccatcatccccatattgaggagtcttcgtgaacataaggaacgcaccggaaacacacttcatgcccggagccgtcttgataatttgcaaagcaggacgcaatacattacccgtcgtattctcagcgccggcgatctcaccgtcagcgtcacccgccttaatcatcaggcaagccaagaacaaaggatcttcaactaaaaccgcagccttctcggaagtcatacccttcttttggcgaagttggaaaagcaagtctgcatacgcggctttcttctcgtgatttttcggatcgacaagagttgcctcaccgatgtggttcagtccgaaaccagccgccaactccttgatctcagcggggtttccaattaagataatgtctgctacaccgtcggccagtaatcggtcggcagctttaagagttctttcctcggtaccttcgggaagaacaatacgctgcttgtcagctttagcgcgcgcaataatgtcttgcattaaatccatagcggaagatattttatattatttaataattgtactcgtaatccggctacaaaattaggcataatgcaatatagagtttacaaaataggcaaaagaattacaggtagagataccagtttcagatcttttaacagtaattcgtcacttcccgctccccggagagtatttgttgcagttcttccgctgtcacattcacacttaacttacctttatgggccacggagatctttcctctctcctccgagacaataataaccagcgcatctgtctccaatgacatccctaaaccagaacgatggcgcaatcccatatccttgggaagggtagcgttctgggcgaccggcaagatacaaccggccgccttgatccggttatcggctatgatcatggcaccatcatgcaacgggctgttcttaaagaagatgttctcgatcaagcgggcatttacatcggcgttgaacatctcgcccgtatgctcatagatcgccaagtccatatcttgctggatcacgatcaaggcacccgtctttttccgggccatattcatacaggccaagacaactggggcgacaaacttcccttctttctccggatcgcctcctcgcttggaaaaaagtttccctaggaatttccagccccggtgcgaacctaacgccaacaggaaacggcggatctcgtcttggaagaggattaccaaaaccacgaaacctacgctaataaacttatccaagatggcccccatcaaccgcatctccaatacctgcgagatcaagatccatacgacgatgaatgatacgactccactgaatatagccaatgtgcccgagcttttcatcaacttataggtctggtacaggaagaaagccaccagcaatacgtcaatcaagtcttttataccgaaatgcatccacatagttaattgagaattgaaagttgaaaattgaaaattatttgttggtcatttgacctatgacgcgaatggcttccactgcttcccgcacatcatgtacacgaaggatattagcgccgttcaagagagcgtacgtattcaatacagtcgttccgttcaggctatccgcaggggttccacccagtaatttataaatcatgcttttacgggagactccaactaataaaggcaactcaaaaatagagaactcctttaaatggctcatcaattcgtaattctgctccaacgtcttactaaagccaaagccgggatcgaggatgatatcattcacccctaaaagccgaagctggcgtaccttccgggaaaagtacagcatgatctcctccatcatatccgggtaatcagtatgcctctgcatagtttgaggggttccacgcatatgcatcatgatataaggcaccttcaaatccgctaccgtttggaacatatccgcatccaactcaccgccggagatatcgttaatgacagccactccatattcctctacgcaacgacgggcaatccccgcacgaaacgtatctacggacaccgggatatccgggtaatgcttatttaatatatgtaaggcaaactccaaacggcgcatctcttcctccggcgtaacctcagcggcatccggacgggatgaataaccaccgatatcgatccaatcccctccctccgataagatttcccggatacggtcctcgatagcggtctcggtctgtttgcggctgcccgcataaaaagaatcaggggtaatattcaagattcccatcaccaacggtgtcgctaaagaagtaagtgtccctctaatattgagcattttatctaacatgatctttccttatttccagcaaagatacaggtttctctcttaaaatctccttctagattcttcattctttatttaattgctacatttgcgccgaattagacaggaataaatatttaacgcgatacagtcatgagtattatcgacctctatgatttatttatacataaccctcaaataacgacagatagccggaactgtccgaagggttctatcttcttcgccttaaaaggtgataaattcgacggaaatcaatatgccgggaaagccttggcatccggctgtgtctatgccgtcatagacaatcccgattattatataggcgaacgcacgatccttgttgataacgtgctgaagaccttgcaacaattagcgcaccatcaccgcaaggtactggggttgccgatcatcgggattaccggaacgaatggcaagaccacgaccaaagagttattggccgccgtgctctcaacgaaattcaatttactatataccgaagggaatttcaataaccatattggcgttcccttgaccctgctccgattgactcatgaccatgagatggcggttatcgagatgggcgccagccatccgggagacatcaaggaattagtggatatcgtccatcctaactatggcatcatcacgaacgtaggccgtgcccatctggaaggcttcggttctttcgagggtgtgatccggacaaaaggggagttatatgattatatccgtcgctccaaaggcaagatatttatcaagaaagagaacgagtaccttcagtctatcgccaaaggcatcgaacaaatcacatatggaaacggggatgatgctttcgcatccggacaggtagtcagttgcgatcctttcttagtgttcaattggaagcaacaaggaaagttgcataccgtcgaaacacatatgatcggtagttataacctagataatgtattggccgccgtcgccgtaggccgcttcttcaagatcccggcagagcgtatcagccgtgctatcgccgcttacgagcctaccaataaccgttctcagttcaagaaaaccgataataacgaattgattatcgatgcttacaacgcaaatccgagtagcatgaaagtagctctggacaatttcatcaccatgcccgtacagcctaaagctatcatccttggagatatgcgcgagcttggaccaactagcgacgaattacacgcagaggttgtcgaacagatcaagaaaggccagttcgacaaggtgttcctctgcggcgagcatttctccaaggtaggcaaagagttctcccccttcgctaccacggaggcaatggtggaagagcttcggaaacagccgttaaagggctatcatatcttgatcaaaggctctcatagcatggggctggagaaactagcggatatcctataagctatcatcgaacaagacggttttcaacttctggtacaagaaggagagaatcaataagataactcccaagattataaagacgaccaccttcccgatcgtaggcaagagccacagatccaccatcaccaactttagcaatacgatcgagaaggtggccaaactaatcatccggacaactttcagatgcaatcgcattcccaccgccatttgcataaaaccggcaagactcaacgagatagagaaacctgcgcttaattcatccggcaagcccaactgattcaacaaattattcgttcccacggctagtaatatcgtagacagcaaacaaatatataaggtcatcccatgcgtacgcttttctcttgcgtcaaatgacttataatagtaccgccccaagacaaaaatatgccccccgattaaaagcaaggaaacccatagcaggaaccggggaataaagagatcatcatacccgacccacaaagacattcctccgaacagggataaagatagccccaagagtagtccgtatccccccgcatttcttgacacaggcaaatagcttttccctaataaaacattcgcagcaaataaaaccgccaccgtaaatgtctcgatatagctaaaggacacgatcgaaggatctacatatgaatagaaatcgaaaacaaaggctatatataatacgacacatcccgtcaagagaggccctttcgtcgagatccttgtcggacgtaccaaccaagcgtctacccaatacgatagccccgtaaaaataccggtagcgaacaagccatttataaatagggaagaatctccgtaccgagcctccatacatccgtggaagacatccattccgtaagagcccagcgtcaagaccggaagtacccaaacgaatatctcgtaaacccgcagacggaaacgactatagaaccagagaataatcattacctctgaagcccaaaacaaggtaataaaggtcccttccagttggatcgggatcgtcaccgatacgaacgtaagagcgatacccaataacgtatgcatcaagaaagtgaaaggttcccctttccgtttgatccaaaagaaaagagcgaagttaatagccgcaacaaaaagggttaccagacctttgtaattccgctcaagctccatattctgcaggagacaaagggcaaagaacaggaatacgaaattgttcaatccgatcactcctaataaatattgattgatcccccggatattgattcgcacgatggaagcgaccgataataagaagatcaaatagaaggcgatagagaaaataagtaaatgcgttaattggacacttcccatcaaatccagatccgcagcatacgtataacccgcaaagacgatccaagtcaaggcaaaacaaattacaggcaattccccccacttcttatagatagatagcccgaacatccctaggtccaagatcatgacataggtaaacagcacccaataacttccatccccgctgcccactaagaatggagcgataaatccacccaccaaagcgataatcgccagttccctacgattatagagtatagataaagacgacataaacccggtaaacaatacaagcaagataaaagcgaccgtttggctgaacagcccgtaataatgataggcgatcgccaccgttacataaaagatcgcaaaagcgcctcccgccagcaaagagctaaaggtacgataggaatccttcaaacgccaagccacgaatagaagtaatccgcccatcccaaagccaaggatcgtacgcaaggtctcgtttatccattccttatctatcgcatacttcacgaaaagacccatgcccaagacgagtatcaggataccgattttaccgaataagttctcaccgatatatttctcataattgacaggcttccgttccttccggggttgaagatttctcgctggttcgacaatcgcccttaccggttcaggttgtacgaaaacttccgactctttcaagatctcaggctccggttcctttatctcgtccgcaacttccgaactattctccaaacgtctacgcaaggcagcgatctctttcgataattcctccgtcttctcctgtgatttggatatcttattacgcaagtttatccaaatcatgatcagtaatagaagtatcagtaaggtatattccataaactctaaaattataagcttaccgcaatatacgcatttatttatataaaagctttccgaaccataaaaaagtcccgacgatacgaatatcgccgggagcaattttttatccggtttccttcctcacggaaatactatcggaagaacttttttactttagtattaaccacacgttcccccatcacgggatactttgttgtgtggaaattatttaattaaatatatttagatagagacgggacgtgcccgcctctactgtatcatttcgaataaaataattatttaacaaccaccttaacagcagcctcaccctctacagctacagctacgataccggcaggtacagcgattgtagcgttatcagatgaaagaactgtctcagcaaccaccttacctaagatgttagagataacaacagacttgccagcggcaccttggattgttacagtaccatcgttagcgataacagagatagcagactcagcagcgatcttgtcattagatgtaggagtgctagttgtcattaccttgaatacttctgcttgctcaggatcagttgtccaataaacaacattgttcaaatgagccaaataagcattacgaggtaaatatttctctacatcatactcttcaccttgctcttcagctgcttcctcatcataagccggattcaaatattcttgaacagaaaggatcttgtaagcctcatcgctatactcagctgcgacctcaaatgcgacagcagccggattcaagttcatcgcattgattgtatcacccttgattgcgatagaatctataccgcatacagaaccagcgataaatgcagcacgaacagcctcagcgccagcagcctcataagcataacccttaacctctgcagaatccaatgtattcatcaaatagtttctagttttcacaccttcttccgcaaatgcattagtagaaagataatacaaaggcatagtctcttcgaaagtcaagcaagcagtatccaaccacaaagtcaaagaatcatgcgtatatacatcgctcttcaagatagactgtccttctgccttcaatacagcgaaaccatctttctggctagcgatcatcttgttatcatcctctgtataagaagtgatctgtacgtgaccgatattcaaagtagcatatgtaggagcatccttctttgcgaactcgaatgtagtattctcagtgttgcaccagctagctgtatatagcattccagatccagctaaagcagagattgcagaaccataataaccatattcttcagtatattcagaataagaaaccaacttatattcattctctacaccagtagataagaaagataatgtaacaggataaacaccattctctacatcaggctcacccattaaataataatcagttccattttcatttttagagcataaagtagccttacctaaacgatctgttacattatacttgtaaactttcactccatttgactcagctacagttgaatttgcctcatctaattcaacctcttctaccttaaatctataagcagaagccaactcaccggcagctacatacaatttgccatctttaacagttacatacaagttctccaataaatcagatttcaaacggaatgacaatgcaccattaaccaaatcttctttagaaactttcttataagctaactcttgagcatcctccactttcgggccttttaccaattgaactgtatctgttccaaaagaataaatagccttcgcatcatctattacgcggataatagcaccacctctagtactattagtattccacatattagccaaattattagtctcagtcaaataccataaagcagtaggaacttctgttacagcaccagcatgaactgtaccgttctcacagaaagagaatacatagtattttcctttgttcttatttgcggaatgatcctcatcagacttcgcattgttcatatccttaacaaagtaagtatactctggatccaatgtagtcggaagcttaacctcagcgaaagtacatttagcagcatccttagtccagattgtcaatttctctgtacctgcgaagttaccaaaagcgatcatctcaccattagcggcaacctccatgtcataacacatttttgacttcttctccgtatcatttgcgcctttatatacaggagtagcatacggataaaggatcatcttgctattatcggaaggatctaaaaccaccttgaaagcatacaactctttcgcacgaccattctctaggatcgtaccagctgttacaccggtagccttatcagcagcagcagcctcatctttaggttgtgcgtctacagtaagtttccagaatttctcagaagacaaattagaagaccaagaagtagagtccacaactaaatacttaccggtagttctatcctgcaaagtaacataaccatctaaaccgtcaatgtctgtagcgaacaactctttgcctgccaaaggatttccatccagatttttgtcgaaagtcaaagcgaaaggagaaccatacttattatttaacaagtcagcagtcatgtttatctttgctggagctgctactgtaaagttaatcgcagatgcagatacagccgttcccttttccaaagtaacaatatctgttctttcagcttccacatcatctttagcgatgatagaaacaactgtcttattatccaactgagcagataaagtaacggcagtcacattctccggagcgataaacgcaccctcatttttgaagttccactcagcttgcttatccaatgtcaacactctgcctgtagcgctattcgtcaatgtgtacgcccaagtattcgccaaagagacaaaacgataagttactttccataaggatttttgataatcagtgttcttgatatccgcagtaggagcatcagccaagatcaaactatcagtctttgtataagactctgtgacagacaaatatttaccatcctcattggtcaattggtaaactttgccattttcaaccttcgcattagcggtaaaggcagtacataaagccaagcccgctacaagagtagaaaactttttgttcataattctaaaattaatattaatactagtgttaattaaaagctctttatatatgcatcccacctaaatgggtacaaaacgactagtctaaacgatcgtttaaactagtcgttttataaacctatcttcatacgatcaatagcatatactatattttcaatagaatttacccttttatcatatattatatatgtacgagcgtacatatataatataattatcaagcaatcaacagatattccttattccttcaagtcttataataatgaaacttttgttcacctatgaagtaactttagttccataagcttaaaactatagcttgatgccgatgcaactaaagtcacaagggcaaaacgcctctttcatgcttttattggtcaaaaaagagagtaatctatgtatttgaaagcttttttcataaatttgtcgctttataataaactgagtaaaaaatgaatacacacgaactttgctgcgtaggacacatcaccttggataaggtagtaacacctaagaacaccgtccatatgccgggaggaacctccttttatttctcgcatgcgataaaacatttcgatgatatcgactatactctagtgacagccttggctgaatctgagatgaaaacggtggaggaactacgagccgaaggtatcgacgttgccgtgatgccaagtaagcacaccgtttatttcgagaatatttatggagagaaccaagataaccgtacgcaacgtgtattggcgaaagcagatcctttcaccgtggaatatctggagaacatcaactctaaaatcttccaccttggtagtttgcttgccgatgatttctctttggaagtggtaaagtatttagcggggaaaggcttagtatcgattgactcgcaagggtatctacgggaagtaagagacaaggatgtatttgccgtggattggccagagaaaaaagaagtacttaaatacgtgcacttcctcaaggctaacgaacatgagatggaggtgttaaccggatataccgatgccgtgaacgcaggaaaagttatctacgattggggcgtgaaagaggtattgctgactttcggaagcatgggatctatcatttacgacggttccactttccataaaatccccgcttacataccgaaagaagtagtaaacgctaccggagcgggtgatacttatatgacaggatatctctataaacgtgccaaaggcgcaagcatagaagaagccggacgtttcgcggcagctatgacaacattgaaaatcgaaggaataggcccattcaacggcactaaggaagatgtgttgcgatgcttagagacagcggaacaacgaatgcctgagtagttgaaaattgagaattgaaaattattcgctctctcctaattttcaattctcaattctctatctttaattattcttgaatgctttgcagaatgtagtcattagcaagatacaaagccctaacaagccgaccacgatataagcgtatttcatattgaaagcctgcgagatcgctccgatcaacaaaggtgcgatcaacgagccgataaagctgatactggaaaggatcgtcaaggcaattcccaccggagttctcgatttagcgcccactaagctataaatagtaggcaccatacacgagatgcccaagcctaccaacataaagcctaaggaattcacgatcacctttaccgtcatcgattcgaacattccacccaacatggctgagataaaaaaacctgctaaaataaagaaacccgctaattgcaacaccttctgctttcctaaaacactataggcggagttcgtaagaaaacggcctaccgtcatcatcaccatgaacaccaagaaaccaatctgtaaggacttaggaacctgcaataccgattcgaagtaaagtccactccaatcaaacatcgcgctttccaccaccaaggcaaacagcccgacgatacctaactggatcaacagcatttccggcttacggataaagctcaacaatgccggagcttctttcttctccgcttccttctcttcctccggtgactcaaccgccacgtcttcctgcaaatacttccggcttaccaaaacagtcactccaatcaataatgcaatcaacgtaaaatgccagaacggagtaacaccggatacgatcatgataaacccgatcaaagcccctaaacaagccgccagactccaacctccatgaaatgaggccataatcgtacgcccatagagtcgctcgataccaattccttgcgtattcaaggatatatcgcaaagattccagaacaccccaaaacagaacaaataaacacccagcagataaatattatgtgccgtacctatcgcgaataaggccaaggcataccccaacacactgacctgcgccataatacgactccccaacttcgacaccaaataacccgctaacggtatcgccacaaacttacctaccgggatcaggaacaagaccaagccccaatagaaagcgtaattcacctcaaaaatatccttcacgtccggaatacggctagcccaactagagaaacaaagaccttgcgctaaaaagaaagaaagcatcgcataacgaatccgttccttgggaaaagcgttgcccaatgtagcattcattttttcattcattatcatttacttttattgttatcatttattcgagaaaggggcacgccccccatttcttcgcaaagctatcaaatatatcctaatatcctaatcccctaagtcttaaatgtagaatttaagagatggcttccctaatgaaaaatatattttacactttggctgaaacacttaattataacttaaaccttcgctcaattgaacaatttgacgatattctccagcaacccatacgttgtcgttttccttgaatacggtttgggatggaggattcatcattgactttccgtctcgttcaatacccaagatcagacaagcgttcttatcccgaatgtcagactgttgaatagatcgcccgatcaacggagagtctggttcaatattaaattgctctattttgatattattattaaagctttgcgccaactgatctctatattctttgtcctgtttttgtattatctcctggaaaagatccaattcctcatccgtaccaacaattataatcttatcaaaaggataaaggcgttcctctcctctaggtatattgatttgtcgttcacctcgaatgatggaaacgatatttattccatatttttgacggaagttgatctctttcaaactccggccgacaatggaggattcttggccaacaacgaaatccatcaagtgcaaatcattgaaaggcaaagatttcaagatattatcagtcaaaggacttccaatgtttgagtccgttgttttcccgttgaagttgtcaataaatcttttctcgatcgagagagaacgctttttcagttttttggataaaataatcattagcaatatcaacagggtgataataaatccaacaccagatgctacattaaatatatggactatgactggcattagaatacttgcgcaaaggagcagctttatcgctatcaaagaaaccaatggtccccggttgaatttactatcattccataatttcaggaattcaggagaatgattcttcttcataatgatagcccaaagaaaaggtaatataatggccaaaataatagataagctcaatagagcccctttgaagcctaatatgttctcgcgaataattggatttacataagtgaaaaatatgataatactgaatattgtcaatactgtatatagtattacatctagtaacatagatttcaacagcttattccatgtacttttatgtttgaccgtgttggatccggaagaataacggttcaacattagttttatagatgaaggcaaataattgtcaatcaattgatagaccggggtcgccatgcgaatcatataaggagtaagaaatgttgtaacgactgatacagcgacaataacaggatacagataatcgtctgttacctttaagctaactcccaatgaagcgataataaacgcaaattcacctatttgggtcagagagaatcctgattgtagagctatctttaatggctgtccggacaagaggacaccaagactcccaaaaaagatttgcccaatgataaccaatatggttaagatgcagattgggacaaggtattcaatcaataaatccggttgtatcatcatgcctacagaaacaaaaaatatggccgcaaacaggtcttttaccggttttaccaatttttctatcttctcggcctcaatggtttcagccaataacgatcccataacaaaagctcctaacgcagaggagaatcccgctttagccgcaatcataaccatacctaaacagaagcctaatgctatgattaataaggtttcgtcgttaagaaatggcttaatctttttaagaaaacttggaatcagatagattccgagtaatgaccaaaatataagaaacgctcctaactttagaatactttccagcatttccattccttcgacttgcttgctgactgctaaggttgaaagcaagaccatcaaaactacggccactaaatcttcgaccaccaagacgcctaatactactcctgtaaatttttgccctctgagtcccatgtcatcgaacgccttgaatacgatagcggtggatgacatagaaagcataccgcctaaaaatatactgcttagatgcgagaagccaagcgcgtttcctgcagtatagcctagaaacatcattccggagactatggttatagaggcgataacagctgtacctcctacggtcatcaacttcttgaaagagaattctaatcccatagcaaacaaaagaaagatgacgcctatatctgcccatatttttatattggtaggatcggataccgttggtatataaggtacggcgggcccggcaagaatgccagcgacaatataccccaaaacgacaggttgtttcaagcatttaaaaatcaatgtaattattcccgccgcaatcaatataaccgccaagtcggaaataagaggtgcaatttcagacatgttattcattattttgtgctcgcaaatttacatattaacttagaaccatgttgggataaaacaaaagtactcttgtcctaaaaacatatatgggaaatattccaggacaaccgcagcaaattcctcctccccccaagagctttatcttaacagcatgaatacaccaatatctataagcggcagtttacgagatataaaaaaagggtcttcattgctgaataccctttcttggtgatccgcctgggattctcctaagagagttaccacgctgatatttaaaactttatatttttagcttcaagcatatcccatgatttatcccactgatttgctacgtgcttttgcggtagtttgctcatggagaatactgggacaaagataacaagatctcattcttattgcaaatttgttgcagaatttatcacttaattaaatcttaaactgagtttaataggtagcagttcctaaatcgctttgtgtaagtttagataaatcaattaatccatcagtgttctttctccaacgtcttctaacatagttttcaaaagttccttgtttaagttccaaattatctgcatggtcggaaattattacttgtggagctatctcaaattctttatatgtatcatttatgaattttaaaatctgatcaaataaatttgtgactgcttttaaatcatcatctgtattctttaaatcaccctccatttcttttagtttgtgaggatcaaaaccatctttgttattatcgacaattgttggaaaatagacttgacttggctgatctaggaataagatacttggaactaagcacttattccctaatgaacagaagtacttctgaataccaaggaaaaggcaaacatgtgaatatagccaattagctccacttcccattgatctaaggtagattttcttttctatttgttctgcctcattctttttcagatgatataactcaaatgtattaatgtcaaattttaagtttatttgtttgtatgatttttcaaagtcaaaattcttgccgatttcattcatagcttcattgatgaaattttcagccgattttaatttgttttcaacatcatactcgtcacttattttcctttccaatgtatcaatatcttccttaagctgttctatgtttgattcttgaattttattttttatatccaacgaccattcaagatggttttctattgataaacgaactttaaatccttgctcttctaatgatttatttttctctaactcatcattgacttttaatattttatttatttcatatcgaatgtgtttaagcgtttcatcaatagcagctaattcttgttcgcatttttgtttttcaggcaaaaacgaatcaatcattaaaggagctttacgtagctctgaatttaaccaatcaatagcatctgatagcttattgatttgaagagaggtattattatttccttgtaaacagaatggacattgagaatcttcttttatcgcttctgaaataggggttatcatatcaattgcttcactgtatttttttgcatatttaatagatgaattgatgttttccaatttcaacattatcttccgccgtgacgcaagaagttcgtttttacgtgtttcaagttttgtatattgttctttgaagacattagactgatcatcaactgttatacctccatcactttgaattttctctaaatatattttgggagcttctagcatattttcagcagaatacccttgtaataggtgattcccaactatcatgtgatattcttccaataactcccttagtattgcagaccttttctttttctcatctttaaattgagtgatttctcgttgcttcttctcgtactctaactttttatcattgatttgttgtttaataataaaatagtcttgatctacaaaacctgcaaatatcttaaattcatctataatcttgtctcttttttctttctcatcgaatcgataaaataaagaatgcttatttgcaataagattttgatgttgaagaatatacgaggtcatgtttctaacagaaggacgtccctttttattgcggtaatttaaaatattgttatcttcatcagttgatgaaatatttattccaaaatatcttcctaactcttctttgtaggcttttagtggaagataataatctgactggaaatattctgattttaaataatcgggcgatggaaaattgggatcaactcggaagaaggcgtaagtacttttttcttcttgatttcgagccaatactaaattcgtattattgatctcaaaaacaagaaaatacaattttgtattatcggttatcaccccatctggtattgtgttttcggaattaccaaagcagaaatcaaatatttcaataatagcacttttacctgtagaagaacgtcctgtgattatgtttaatccctcaataagatcaatataatgacaattttcttcgttatctattaaaccgatatattttatataacttttcataagcctttaattccaaatgtataatatgtattaattatatcttgcgtaaatatttttggtagttttgatgcaaggtttatggcatcattaaatgatttatcagtatataagatatccctattggtcacttttatacttagattttcatttatttcaatatacttgcaatccaaagcatattgtaagcagtcgttagtaatctgctgaaattgcttgaatctattctggaatcctgccattatctttttatttgctaccaatcgtgttatatttgaatttctattaacactttttatttcttcaatagcaattggatttagcactatcggaagaatgaaataagcaattaatatatctttttctcttgatgtataatttttgtagaaagaaattattattggagttagagaaaagacattgttatgtataagaaatatattatcaacaaacttactcatgtttttagttttataagccaaacaaaatcttctttttcatctgctaaaatgtgtaacattccattatgaaagtaagctggaacactattatatatataaaaagtactatcattagcagacatcatattgtcatagaagtcttgagaatgaataattttatgtctattgtcagaacagtgcctacaggcttttcggtattctgtattatgtctctttaagagagtttcttcatattcatttaatgaatcagaaattttctttgatgttatgatttcatttattattagttctttagtttgtacataatctgttattgcttccaatactacttcattgtattcaatctgtttgattttatcaacgaacgggtttgtattgtattcttcgtgttttatatctatcaaccttattttagaaggaaaatgagtcgtcgtatcaattagactttgagcgagtatatttacttcttgcctaaaatcatcatatgtaatactccaattattatcaattgtttgaggcgaaattacatatcctaacatggagcgaataaattcatcttggcgtatttctggaattgttttagcatgagtttcttttatgtatttgtaatatttaatatcattcaaggcattgttatcaatcacaaatttcttcaatgcaatttttaatctttcaaatttagcctcatttaatactgattgaatcagcttttctgtcttagcatccttacttgacttttttctatagtattttaatgctgcattttgtaatatttgtaacttttcagcgatatttttatcattccatccaaacctgatacttgttgatttaacgttttgcgtagtcaataaaaccaaagaagagaaagaatcaataggaaaactctccttaagccagttattcaaagtattccatatattatgatcataatcggtcagattctctttataaaatttagattctatttgtactgtgtcgttacaacccaaaatagatatatcaccatatgtttctatatatacagtttctccagcttgtaactcgaagcattttcctaaagctacaagaaattgataaattaatccttttattgtaggtgttgaattattacttagtttcaccatatctacaaattattttacatctgcatttatactaactacagtgtatgcaaatataatatcttttcttcacatatttagatactttaggtataatctttagactatcaatacatttgctaccttatccttcttcttttttcccttttgctctttttaggattagataaaagttcttctggattggaaaaagaacttaccttcgttggagtaaatgaaatgagtgaactagatattgggctattttggagggttatagggattttagtttctagctttgtagaaatattagtatttgtattgtcttctaaattactattttgtttaatttctgtttttctttcattaggttccaatttttgttcttgtaatttgagttgctcatatataggattattcttcatagtgttttgataatcaaatgcttctattttctgacggttgtaactaaataacttatcaaacccctgttctatctgctgaaacagattcacacggtcaaagccaccttttattattccgttctttgtattcttatgattggtgagtggtgatagtttctttttattagtttggtcttttcggctcacaatcaaatggcagtgcatattcagttcattgtcggaacggctacggtcaaaatgtatctttccgtaaaactttatatctgcttcggatagttctttgttgaagttcttggcatattcagggataaacacctcacgaatatagcatttcattgcttcggcttgttcctgttctgtgttacccatcgcccggagttccttttccgatgggctgatgtgaatagcgtaaaacttagcatccgtttttaggagttgcccaatatttgtatctatatcctttatgacctttgatttatagatattatcatctgtaagattgaaaaagccttcagtatagatgcctttctccatccgttctaaatcttcatgctccatgtaattagctagctgtcggctactaccagtgttattatatgttccgtttgatggtggggcaaagtctatgtgcattatcctatgtgtttatcaaattgctgatttctgctttcaggttctctttccttttgctatccatcaccccacaagcagaaagttccgaatagagttgtattaggtggaacagttttttataatcccgttggtgtatctggtaaagtgcgttaatctgtttggactgactgtttattacatcggcatgattgcagaactgctcacttagttttttaagtacagctgtttgtttctcctgactggcttccaattgagagagaataagagtttctaaagttttgccgatagcatcgaaacgcaaagcgatagaatttgttactcgtatcatggggttcagttgttcttcctcatagtgacggatgaagcggataatatcatcctgtctcttatttattttcgccagttccgattttactgattcaggggcttcggatgggttgatatgtgccttatctatatacccgaacgccaactttacaacttcactctttttcagtgaatagcgtttgcatatcttctctaccaaagctgccgtttccttgtctatggaaacggtagtgaatatcgtttttcgactgttgtttggcatggtaattacttttttatagaaatatgaatagataaatacctgataataagcattacaaagaaaatgcttattacaggtgtcattacagcgtgttcttgtaacacgctaaagccgaaggctttgccccgcagggcaagagggaagaacaggacttgtccagttccctcttgctcgatttagcgaaacgggctgaaccgataggtgaagcagtttttgttaaatcgaggtgacaacacaaagaaatagcccgtacacaggcttcttccttctactgcattttgctatcagggctgatttgtcaactgattgtctttttcaaaccgtttgtaggtttgaaaatcggcacgttcacgaacaaaagttcgaatatctacagcccgataataggttttccttccgatagtgaaataaggaagttgattatttactctgtagcgttgaagagttcggaaagatactttcaggagaaaagctaaatcctgattatcaagaatcttctcattatcatctagtactgtatcagtattgataagagatttcaaatcttgtccgattacggtgagttttttggatagtttctccatccatttcttgaaattttcgttatctatatacattttgcttcattttttagtttaacattattgttctcaatcgattgatgaagcaaagtacggtaaatggatgcaaataagttaggggtgtagtatatctactcccctaacaattgttggtaagttcctgatttatagatagcctttctttttactttcttcggcaatagctttgcgaagtgtatccaaaaattcgattcgtttattggcttgccgacaaattacactttcatgctttttgtggatgtccccaaatttgatattgaagagatgttcaaaggctcgtccgatttctgttaatggtgcttctttcccggcatggtttataattctcttagataggaataatccgctaactagttccatgatttcaacaaggttagtttcatctgtcagatagagtggcgattgtggattaccatttttccggttttgaaatggggttggatattgaatttttaggttcaatagctccagttctgaattgataatagccaatgtcttttgtagaaactgttttttaagcacattttcccccctgcccataaagaggtacagtttcaagtgaagctatctcaatacgggtagctacaagaatccggaaagtagtggagtaatcatttccattactcatggctctaatttgttcgacaaattcaccataggcattttgcatttcttcggttgttacttcttgtgaggtttcaaataataaatcactcaacctcgttttcaataaatcattcatatatctaatatttataaagtgaaaaatatcatttatgcacaatattttttaggcgtgatttattgctttttgaatctattccttttgataatacttttctcttctaatttcataaaataaagaaggtgttttaccattataaattaaatcatcaatatatttgagtcctaacctattcatcattttgatagaacggttattggcagagtgtgtgtatgctacaatccgattgaaatcagctatactaaaggcatgtgcaattattacttgtgcagcttcagttgcatatccgtttccccatgcggaatatttcaaccgccagccaatttcagtagcctgtctatcatcttttactggtaatagatgtatccaaccaaggaaatttattgggttttctttcgaaaaaatagaccaatatcctaagccagaggggtaggatttcaaaattctctcttttagaaaggtaagatgttcgtatgaaccgttccattcccccggtatatattctgtaacctgtggagctatgtccatctctatacaactttcgagatcgtctatagttcggggcttgagaatcagacgaactgtttcaaatgttggaagcataacacttataacctttttatcatttcaaattgttttcctgccggttctatatttttcgattgaagaaaagttgtaattgaatgacattctatgtcggtattaatgatcttaatagaactatgtttattgctttcgagcatcttctgaaaaagcaatgaaccaactcccctgcggcggaattgtttatcaacagctatttgagtaacatccccagagataggttcaaaaactccatagccgataagattgccttcagaaaaaacgcctaaacaaataaagtcttttaagcatctctctatcgcttctatactattctgccacgagggtttgaaatcccaaaagttgggtattgaattatattcatcaattttaattggcttcaatgtataagggaaatcaagcgttctaatagtcttgctaatctgattattttttaacttgaagtaataaaactctcgtgtcacctcgaagcctaatttcctataaacggagagtgcacctatattatgcagtaatacttctaatagatattcctttactcctaatgcttttaaatggggaattgaatatttaaaaacctgcgtagccaacccttttccctggtagtctttcagtgttcctgtcccagtatcgtaagcagttggtgttccatagaaattccctatcccattacacgtaaacgaaactattttatttccatcaaatgctccaaaagaggctttgggttcaaagccacgccgttttagcatagttaaaagctctactttgtttaactgcacttcataatcggcaaaagcctgttcaaatgcctcaaataattcattaagacatatattatttaaagatcttatttccatattcatactactttatttacttttttgcaaaagtagtgaaatggtatataatagttcattgacctatgttaagagatttaagtcggctcaatgattctggtttaattccgagataagcggcaatataatactgagataggtgttgttctatttgcggataggtttttagcaataatttatatctttcaaatgcactatccattaggaaagaagtttccttcctgcatttcttaatcaacaagctatcagaaatatattttccaaatttaaaccattcgttcgattcttcgagtaattgattgtaggctgaactggaaagtgtgacaagatgggtgtcttccaaagcctgtatgcttccgatactaggctcaccagtaaggaaacttttgtaagaaacgacaattgaaccggaaaagtaaaagtctttaatgaactcaatagcatctttctcaatataggaacgtaacacaccactttcgattataccaagattataacaaactttgccctgttggacaaacatctctttcttcttcaaatatttagtttctgccaattcaagaaacctatcgcacatatcgttcgatagatttagttcttttttcagtatttgttcaacaacgttcatttgtttatcaaataatattatactataactcaatgatatcaaaggtaataataatctttgatatcattaatagtctttcctataaaacaagactattttagataaatctaaatatttcaactaacaagatcgcttttgatttgagtaatagtgattctgtatttcatgatatgagttatctgaacagactatggaaattgatttatttctatatcggttatttatacttagcttattgtcaataacagtcactttataccacttccagacagtttttaaaacgtctcttgattcttctttcatttgccgatgaaaatagaatcaacacgttttataaaccatttaaaagagaaagtatggaagtagtaaccattgaaaagagaaccttttcgtatgtctgcgaacggttcaccgagtttgccaaacgaatagaaagtttgtgcagcactcatacccagaaagtagaaaactggctggatagtcaagaagtgtgcctgttgttgggttttagcaaacgaacactgcaatattaccgaagtagtggacggctggcttattctcaaatcggaagcaagatttattataagtcttccgatattgaaagaattattgcggacagtgaaacacaaaattaatcactcaaacaaaccacattttatgaaaagagctaaagaagattacccgtccttcaatctgttttccattgttggcacatgggaaagcgttaatctgaatcctacgataatcctttatcggagcgataaagagtaccttctttctattatatatgtatcggaaaccactaaacaagcttcacccgctacttatgagatacagcaagatggtagccagtattttattgccactgcatccaaacgactctatgtagattatgattcggcaaaagatgtacttagcatttcatcgctgggtgactatctgggtgactatctgcgtaactagccagctatctagccatcttgaaatcaatatttcaataaaacaatctttcaatcatggaactaataaataaagataccccacaagtcaaagaatttatttcttcgcttgattcgatgctgaacggtattgaatctatagtcaagcattacaagccacacctgaacggggagcgttttctttctaacaatgaagtttccaagaaactgaatgtcagtttgcgaaccctgcaagaatggcgagatacagggctaatcccctttatccagataaaaggtaaaatcatctaccgtcagagtgatattgataaactgctccaaaaacactactttgaaagttggaaagagtaacctgccaagcccaaaacattgtttttcggaatttaatttgaatcattgacttttccagtgaagtatttagtctgtgcaagtctttagatgaaaatacgctcgaacatagtgagaggaagattttcatctaaaccgaaggctcggacttgaacaggctaaatacggaacttacctttgtcaatgcttcatattgagttctggaaaacttactatgaaagaaaaggattgagaaaatgaaattcattcttcccaatcctttttcaatattagctactatctttattatatagccaattccgacaggcagctatttactttttgcatatccttgaaaatattctgatccaatacccttgcatagtgttttgttacgcttgtatctgcatgacctaacatcttagcaacattctccatactcacgccatttgcaaggcaaatgcttgtggcatagctatgacgggcggtatgagtgctaagatttttatgaattccgcacacatcggcaatctccttcaaataactgttcatgcgttgattacacaatacaggtaaaagttttccggtacactctactacatccttatatttatcaagtatagaagctgccacaggcagcacaggaatgttacacatgatttttgtcttttgccggttcttccttatccaaagttcccctttattgtcttttaccaagtgttcaggcgataaatctttcacatcgctgaacgccaagcctgtaaaaatgcagaatacaaaaacatcccgtacctgttctactcgtttaatggtgaactctttggcaagaatgattttaatctcgtccatcgtcagaaattcaggatcggtttcttccagtttgaagcgatagtaggcaaacggatctttttttatccagtcgttttctaaagcaatacgaataatcttcttcaagttctttagtcgggtgatagctgagttctgcgcacaacccttttcaatcttcaagaaagcatcgaacttagaaatgaagttcgcttccaagttattcagagcaatatccgatagctgatattctttcttaatgaattcctccaaatatcgggtagtggtttcataccgttgaacagtcttgcttacaaagtctttgccgatcagcttacgactttgttcattatgttccctgaatacctgtaatagtgttttgttatcttcgtccacaccataaaacagttttctaacaagatcaacagtgataaccttgccggaagtttccagttctctataaatttggtgtacgtgcgaacgtgtgatttctaagtagtggttcagttccaccgacatacggtctttaccttttgaattctcttttgcctgattccataggtttaagggacagcttcttttgatagaaatatctaccatacagccgtttacggtgattctcatgcacacgggtgcttctccgttctttaataatttgcctttcttgatgaagaacaatacagaaaatgattttcgagccatttttacatcgtttttaaagttacaaaactatgtattctcttccaaagtaagtctatgcaaaatactatgaatcagtgagaaaggtgcaaattcgtgggacttttttgaactaaattttagtcccacgatttatccaccgataatatgcttgaaacggctattttttgctacctgctagaaaaaagaaatccctgataatatctgattatcagggatttgcttgatttttattttgttttcagtgatccgcctggggctcgaacccaggaccccaacattaaaagtgttgtgctctaccagctgagctagcgaatcatcctatgcgttacttctgtaatgcgggtgcaaaggtagggatatttttttaatacgcaatagatatggctatttttttgcgattaaatctgaatttatttcctcttgtttaggttgatgagcaaggcttctggaatctaactcattatattcatgcaagataaatcgtttataataagataagcataaggttgttaatgggagggctattattaagccgataaagcctaagatcgttccccagatggataatgagagtaaaatgatggcgggattcaatcccatagccttacccattatgcggggggtaagatataaatcctgtatacattgtacgatacccaagactaaaatagccaaaccaaagatcaaccagaagttctcgcctgtctcggccgaacgcaataagctcaatagaatcatcgggatgataccgatcgcctgcatatagggaattaagttcagcacgccgataaacaagcccagcgtgaccgccaacgggaaattaatgatcttaaaaccgatcgcgaggagaatcccgacggagagagcgatcagcgattgtcctcggaaataacggttcatgctgtattccacatcctcagccaaaccttgcaggaacggacggtaacgctccggtatcaaatcgatccaaccattcgcgatcttctcatagtccaaaaggatgaagataaaataaagcaagatcacgaacacgatcgtgatactgaaaaggatcgagaaggtgttcgataagatagaccataactggggtgctatctgcttcaccgctttcaacaaattctccttactcaataactccataatctgagcgaagttcacattactttccagatattccatccatgaatgcggaatcaaagggacatgaccttcaccgggatcatgtgtgcggatcagttctagcgttttatccgcctcagccgcgatggaaggaacgaccatgactatcagcaacgttatcaacagccctaaagtcaccaataccgccataatcgataagatacggctcttaaagcataatttatattggaagaactttacgaacggttgcatcatgtaagccagcaaccaagcgatcaggaaaggtaacaatgcgttccgtaataaggctatcaaatagataatccctgagatgaccagtataccgaacactatgcgtattacacggtcaaacgtaaaaggcttgtcaaacagtggattcatattattttcatatctttgcttgcgacaaagatagaataaagtagaatatataaacatcatgatacgtaaaatatcctttttcttcctcatttcttgcttatacctttcagtaggggcacaggttccacaacctatcaagcaattcctgcgtaagccttatatggaaggagcctcattttccttgatcgtgaaagacgttcacaatggcgagacggtattcgcttacgataccctccggcagctgaccccagcctcggtcatgaagacggttacgaccgctaccgccttggagatactgggcgaggattatcgctttcccacgacattggcatacgatggctccatcgagaagggcttgctaaaagggaatctatacatcaagggaagcggagatcccagccttggctcagcgcatttcgccccgtatcataagcggttcctacaggaatggatctccgccttgaaaaaggtgggtatccataaaatacaaggtgccgtaatcgctgatgaaagtatattcgacacggaaggcacttcctttaaatgggttggcgaagatatgggcagctattatggcgccggaagctatggactttgcgtattcgacaatctctataaattaggactgcaaaccggggctcccggaagccgcccgaagttgaaaggaaccgaaccggaattatccggcatccatttccataattacttaacggctcagcaagtatcttcggatagttcttttatcgtaggggcgccattcgccacggaccgttatttatacggaattgtccccgctaaccgggaatggtatccgctcaaaggggatatcccggacccggctcttttcctagcggattatctcactaggcaattggaacatgaagggatcacggtcggcgaatcaccgtcttgtttccgtatcttgcgggaggccggtaggtggcaacccgggaaacggaccgagattgttaccacttactcccctacgcttcgggaaatcgtggaagtgaccaaccatgtcagccataatttattcgccgatgccttgatcaagacaatcggcctacgctatacgccccgtaagggagaggtcatatcttcttttaaccggggcatccaggtgcttcgggactattggcaagggaaaggactcgacctctcgtgcgtctggatgtacgacggtagtggccttgcggttaccaacaagttatcaacagcttttgtggctgatttattgatttatatgagaacccgttcacaacaacacacagccttctacgaatcattgcccgtagcgggggtagaaggctcggtgaggaacttcttaaaaggctcatccctccaaggaaaagctcatcttaaaagcggaagcatgagccgggtaaaaggatatgcgggatatataaacaaaggcgataagcaatacgccatcgccctattcgtaaacaactattcctgcgacggacgtcctatgaccgtagcgatagagaaattattgctccagttgttcaactaaccagcggttatttcggcaggatcgatctacgctctatcatctctaggaaatgctgtttataattgtcggagatcgggatatactcctttccaaagacaatccgattccgctcgatcaccttgatcttctccggctggacgataaaagagcgatgaacacgcacaaagcgatccgaaggtaacatatcctccaaactcttcatgctcatcaacgaaaggaccggacggggctcatcctccacgaatatcttcacgtaatcctttaatccttcaatatataatatcttgcgcagctctatttgcaacagcttatactcactcttgacgaaaatactctccatcccgcccctctccgcgattgacgcggattcctccttctcttccgaagacaccggcttacggagcaactcataccatcgcaacgccttattcgccgaggcaaggaagtccggatagctgatcggcttcaacaaataatccagcgcgtttacccggtaactatccacggcatattgatcgaaagccgtcgtaaagatgacacgggtatcggcgttcaagatacgggagaactccaatccgctcaactccggcatctggatatccagaaaaagcagatccaccggccgatcccgtaagtcggaaagagcgtccaaggcactattataagtcccctgcaaatccagaaacggagttttcaagacgtagctttccagcaagctaaccgctaaaggttcatcgtcaataatagcgcaagtcaatctcatatctcagtctcgtttatagtaattgatagataagaagaatagttatccccctcccgaccgcattggaacgagaaatgccccggatagagcagccccaagcgtttctccagattcaccagcccgataccggaaccacttttatcttgatccgggcttttcgggaaatagctattcacgatagtacaaaccacctccgccccctcctgatggatatccaaatggatgaaagacggcttattattgctcaccccatgcttaaacgcgttctcaaccaaggagataaacaacaggggagcgatcaaggttcccggagaggaagcgacgatattcgttttcagctccacatgtttgggcaggcgtatacgcatcaactccacataattacgaaggaagtcgaaatccttctccaaagggacaaaaggctggctactctcatacaagacatagcgaagcaagcggctcaaatcgtgcaccgcctcctgcgccttctccgggctgaacgctatcaagctatagatattattcaacgtattaaacaggaaatgcgggttaagctggcttttcaagttctgcaattccgcctcggcacgctccttctccagttcccgctggatagccgccacccggtaccatccgtccgtcatcttgatcgccacgctaaggccggctaccaaggagtagataacggcgttgacgagaaagaaccccaccgtctcgttcaacgggcggggcggacgagccggatgatgcatctccggcggatagaaatagcgcatgcagagatgcacgaacagcatcatacccccgataagcaataggttgatcagcaggaaacgccctgtccggcggttaaacaaataccgcctcaccagccacccgtaattcaagtagaagacgagcatgaaggaaagcggcacgatgatgctccggaaatagccctcgaacgtgacttgcgactccctccccgtgaagaagaagggggaacagaataggataccccatcccgcaatgtgtatcaactttcccaaacctttgatagggggggattgtggtgtgtcattcatcttattatcctctttagtgctacgcaaatatagtcattcctaccgttatatgagccatgtagccttatctagtgagcattcgtctactcatagcgtatggcctcgatcgggtcgagctgcgccgccttcttggccgggtaccatccgaagaacacgcccgtcaccgtacataccacgaaagagagcagtacgctccatggctggatatagatcgggaaatgcgccacgacattcacgatcaaggcggctcccacgccgaaaagcacgccgatcaatcccccggtcacgctgataaggatagactcgatcaagaactgagccaagatatccatgcctttcgcaccgatactcatacggaggccgatctcccgcgtacgctccgtcacgctcacgtacatgatattcatgataccgataccaccaacgagaagagagataccagccaccgcggccagcaacgtcgtcattatatccgtcgtacttgtcaacatcgtactcaactcctgcatactccggatcgtgaaatcatcatcatcggtttcccgcagcctatggttacgcctcagtatctccgatatctcgtctatggcttgatcggtgtactcctccttgagcgccgagcaggttatgccttgcaaatgggtaatggccaagatcttcttttgaatagttgtgtatggagctaagatcaggtcgtcttggtccattcccatgctgttatatcctttgcttttcagtacgcccacgacccggaacggtagcttctggaaacggatcacccgtccgacgggattctctccgccggggaaaaggttatccaccaccgtcttcccgatcacgcataccttggcggcggtctgtacgtcttgatcgctgaacatatcgccatcctccacctcgtatcggcgtatctccatataatccgggctgataccgtagacggtggtcggggcattgttggcgccatagatggcctgcccgctactgttcacggagggagaggtggcggagacgtagcgagtctcgttcacgatatcctcgtagtcctgtagcttcagcgtctccatggcagaggcgtcttggcggacaccaccacgcatgtcggctcccggctggatcatgatcatgttcgagcccatctcgctgatctgcgcctgtatactccgcttcgaaccttgaccgatggccagcatcgtgatcacggaagccacgccgatgatgatacccagcatcgtgaggaatccccgcagcttgttgttggccaaggcccggagggctatctttagtaaattcgtcgtattcattgttacttctgtttatcgcttaatcatcattcttgggcaggcgggccaaagcctcggcggcgctcaagatattcgtattcaccgtatcggcggttacatgaccgtcgcgcaacgtgatattccggctgctgtattgggcgatctccgggttgtgggtgacaaaaataatcgtacgtccctcggcgtgcagacgctggaagagcaccaagatctcaaaagaggtacgggtatccaagttgccggtagcctcgtccgccaggatcaccgccggatcgttcaccaaggcacgggcgatcgccacacgctgcatctggccaccggacatctggttacttttatgcatcagtcggtctcccaagcccacggcgatcaaggcgttgaccgccttctccctacgttgggccgctttataagtaggattgtacatgagaggaagctctacgttctctaccgctgtcgtcttcggcaacagattgtaattttgaaaaacgaatccgatcttgcgattccggagggtcgctcgctgccgcttgttcatggtgcgcacggatactccgtctaagtaatactccccgctcgtaggagtatcaaggcaacccagcgtgttcaacaacgtactctttccggagccggaggttcccatgatcgtaacgaactccccctcgcgaatcgtgaacgacacgcctcgcagggcatggacggtctcgtcgccaacgtggaagtctcgttttatattgtctaatctgataatttctttcatgacgcaagctatctcttatttttgttgcttcccggagggcccggcatgaaagggctacgctccgctcctgcacctacttccggcatgttagcggcgctcgctaaatctacggctacctcatcgccctcgctcaagccctcggttacttcggtcacgctgttgttgctggttccgaccgtaatctgcctcgggctcaaggtatttccttggcgggaccaaaccaagcgttttccgggttgtacctccgcattcggatccgtcacggtcatacccaacgattccatgatggcgggctcggggataaaacgaagcgccttgttcggcaaggtcaagatattcgcacgttccaacgtataaattgtgacatttgccgtcaagcgaggtttcagtttcaagtccggattatccgccgtaattactacctcatacgtaacaaccgtggaagaagaagtactggaagaagcactggaagtgctttcgctgtcccctaaacgaatctgacgaaccacgccctcgaattgatcgttcggataggcatccaccgtaaaactaacccgttggccttcctccacattacctatatccgcctcatccacatccgctattacctgcatcttcgtcaagtcggcggcaatggtaaacagcgtcggggtctcgaagccggcggcaacggtctgcccttcctcaacggcccggttgataaccactccgtctatagggctcgtgatcgtggcatattccagattacggtttacttttaccatggaggcctgactctggtcgtaagcggccttcgccttctcataattataggtagccgtctcataatccgtatcgctaatcaattgtttctcgtgaagcaccttgctacgtgcgtagttcttctgttgatactcgaactccgtcttgctgctcgccaattgcgcctcggcggaacgaagctcggcttggaggttgatcttatccatctcggcgatcagttggccggctttcaccacgtcgttataatcagcgtacaatttatcgatgataccggagacctgcgtacctacctcaacctcggtaacgggctctaccgtaccggtggccgtaaccgtattcgtgatcgtgctgcgccctactttagcggtctccagcttgattccgcctttcgaggatttgcccgtgaaaaggaacacgccccccgcaatgaggataacggcaacaccgcccatgattagtttcttcttgtccatattctgattcgttttatttctgttttacgttgtattcttgttcaaaaggcccccgcgacctccgtcgcagggtaaccttgaaaaaagagagtggagtaaatatatatatccattagtgggttaataattctccgcaaccggcttcttctgataaacattcagcaattgaacgctcatcaaggccatgtatttcgcttgtagctgctcttgctgggcggtcagataattgttcttctccgtcaatagctcaagcgtatttttcataccgaggctgaattgctcatcgatcaagttatagctttctttcacgtaactcaagcgttcggtagccgaggtatattgggtctgcgacgaggtagcgtccagatagatcccctccacggtttgcagcaattgcttttgggcattcagcaactccaactggctggtggtaatcgcgtatttcgccttgttataggccgtcttatactggcggttactgaagatagggatgctgatcgtcaatccgacactctcgttgaagctattccagatctggctaccgaaagcgtaatccgttccggaaagatggccggtacccagcccggcgttcatggagagcgaaggaaggaaagcacctttcgcctttttcttctccagctcggcgatgtccacggccagctcactgctctttatttgcggcatcacggccagagaggtattgtaaatcgtttgcttgctcggaagcggggttaagatatctttctccgtaagctccggcatcaccaattcgatctcttcggttatatccagttctagtaattgcttcaattgcaacttataattgtctagattcgtctgggctacgaccaattgatatttatcggtgcttaactggctttccaactgagccaaatccactttcgagatcgaaccggcacgtagcaactccaccgcacgatcccgttgcgccgtagatacctcgaccgtattttggttgatacgaacggactccatcgcatatagtacctgcatataggtctgtatcaaggagatttggatatcatcctcgttttgctcgatacccagctcatcgacggtattttgtatttcctgttgcttgatcgcctgtacacgttgccctccatcaaaaagcgtccatttagcgttcagcgcataattaccgctatagctattattcgtagcggcgtcgctcgaaggataattcacgaatccttgggtaaccgaagccgaaagggaagggaaaagctgtgctttcgcctgcttcgtatcctctataccggaaagatgcgacaccttgcttttctttacttggatattatgctccaaagcgtaatccaagcaagcgcgcaaagtccatcgggtaggttgctcttgtgccttactccccacacagaggaagaacagacatgcgaataataaagcgtattgtttcatattgccttcgttttctatctttttacgaaagcaaaactatattaccttaaaaacatgggcaaccagactagaaaaaggggctgttttcaccgattaaacgggcaattgcatcgacaggaaagcgtgcggatatatatttataaggccatcgatttgacaatttgacaaaatgataaccgaagtcccggagaatcgattattccgggcaaaggtacggctcactcccaaatacgaaagaaaaaaacggcaatcatctcgctaatagacgaatacccaaaaacagtcttttattccagtgaaatgaattcatcctaattcatctatttagacaagaaaaagggtgaaacagtgttacgatagggttgtaacaggctacgaatgcctattcacaggtactcacaacccaatgcacagccgctcacaacgcctaacgcaagtatacgcatcaaggaatgcgtcctctcgcaagctgtctcgtcacctattatgtcccaaatcggcctctttttaacgaaaaagcacgcttatcaccacttctttcccacaatctcgctacctccgcacaaaaggtgtgtcagcggatttgcgttatatcgagcaagaagtaagaataaacgccattccacctatcttttatcggctcaaaagtagtcattcttcttaaagaatcagctcaaattgagccgatttgatcctcaataatacaaaataaccccggcgatacctgccaaaataatcatcaagataggatgtatcttgaatttccaagtcaagataaaggcggcgccaaagatcaagaagctcttgtagtcgatgaagttctctttattcattaatagcaaggcggcggcggcgatcaaaccgaccgtagccgggcgcaatccaaggaaagccgcctctacatatttattattccggaacttagcgaagaaataagagatcaagagaaccaatatgaaagagggcagacataccgcgaatgtcgtcaggcaagaccctaggatactcatcgtctctgaataccccgcattatgcaccgccgtataccctatataggtggcgctattgataccgatcggcccgggtgtcatttgagagatagcgacaatatcggtaaactcctgcaaggaaatccaaccatagcggtccaccacgtcggcttgtatcaaggataacatcgcatacccgccaccaaagcccaatataccgatcttcagatatacatataataattgtaaccaaatcatatcagcccttcttatttaaaccatacaccaaacctccggctatagccgccaagataatccaagcgggagacaccccacccatccagatcagcaatgccgccccgacaggtatgatcatttgcacgtaactcaacttgatagaacgtgcggttgtcagacaaggcacggcgatcaaggcgaccaccgccggacgcaatcccataaacgccttctccacccatacattatcctttacctgcgtaaagaataacgcgatcaagagcatgattacaaaagaagggagaatcgtgcccaaggcacaaacaaaaccgccccatgtcttcttcagtttataacccacgaagatcgctatattcacggcgaaaatacccggcaacgattgggccacggagaaaacatcgataaagtcctctttcgtcatccacccccggtccaccacatcccgctggataagcggcaacatggcgtatccacctccgatggtaaacataccgattttcacgaatgtcagaaaaagcgtccaatacatacccttatcagtttacgttggctaacgtcctaaaagcctattgtaagtttctttattattaataatctgaagcgctttctggtaactcggattatcatcattgataatctggaagtactgcgccatatcatagagatcccgtgcgataagcgccttgatctgaagcataatcaacggcttcgaacgattatattgctcttcctcaaactcaatcttctcatcgccggccatcttaagaagctcctccatgatatcctctccaaccacgaaatattgcttatattgctggaacttcggatatttagccatcatctggttccgattacgatccagataattcatggacacccgattgactaaaccggaagctaccagtttccggtgataatccgtatagcgagtcgtatctaccgggatgaacacgtccggcataatacctccacctccatatacggtacgctcggtaaccaaggtgttatacttcattgaatccgggaaatgaatgctatcggcactcatcaactccccccggttataacggtcgatcagatcatggtggtactcctcgatcttcccgttctcgtaaggcttttgtatacaacgtccggtgggtgtatagtaacgggaaaccgtcaaacgaatcatggaaccatccggcaggggaatcggtttctgtaccaaacctttaccaaaggtacggcgacctacgatcactccacggtcccaatcttgaatagcgccggagacgatctcgctggccgaagccgaggactcgtccaccagcacgaccaaacgtccctcttggaattgtccgcgagcggtagagttcgcctcctcacgaggttgcttactccctttcgtataaacgatcaaccggtttttatccaagaactcatccgccagctctatggcgatattcaaatatcccccgccatttccctgcaaatccagaatcaagttcttcataccctgtttccggagcttctccaacgcctccctgaattcatcggcggaagaagcggcgaaacggttcaacttaatataaccggtattcttatccgccatataagcggcatccagactatacacgggaatcttaccgcgaacgatcttgaaatccatcaattccggcgacttgcctcgctttaccttcacacgcacctcggtacctttcggtccgcgtagtttcttcatgatatcggtagtcttcatcttcacgccggcgatcaaggtatcgtctacttggataatacggtcgcccgccatcaaccccaccttctcagagggacctccggggattacctgaatcacgtaaagcgtatccgtcaacatattgaactgtatgccgataccatcgaaattgccttgtaaaggctcggtcatctctttcgtctcctccgggtccatataattggaatgagggtctagcttatccaacatgccgactatagcgtcttccaccaacttcgtctcgctagtagagtcgacatatagattagagatggcgaataaagccaattggagcttccgggcatccatattcgctttttgcgctgtcgctccggtaaacacacctaggacgatcagcagggataagacgattcttttcatcagatatattcgtttcataattttcaatacaatctcgtctctttagggacgaattgagaaatgtctttgccgtagcgtaacaactcacggacaatgcttgagctaatatgcgtatgttccggttccgtaaacaagataaaagtctcgatacccgtcaacttacgattcacgtccgcgatcgtcttctcatattcgaaatcattgaccgtacggattcctcttaagataaagccggctccgacctctttagcgaaatccaccgtcaattgattatatgacatgactttcacccttggattatccttgtatagattccagatcgcttccatccgcttctccaaggagaaataggtaagcttcttatcgttgataccgatcgagatcacgatctcgtccaccagttccaacccacgccttaccaaggattgatgcccgatcgtaaaaggatcgaaggtaccgggaaaaagcgcgatacgtttattttcaattgatgacatcttcttcaaccactaagttatcgataataaagttctgtcgctccatggtattcttccccatatagaactcaagcatatctttcacgaggtcctctttcttcattgtcaccggatcaaggcgtatatccttgccgataaaatgcttgaactcatcgggagagatctctcccagacctttgaatcgggtgatctccggattcttcccggcagcggctatggcagccaagcgttcctcctctgaataacaataccacgtcttctgccggttacgtacccggaataacggggtttgcaagatataaacatgattacgcttaatcaaatcggggaagaattgcaagaagaaggtaatcaacaataaacggatatgcatcccgtccacgtcggcatctgtcgcgataatcaccttattataccgcaaaccttccaagccatcctcaatattcaaggccgcttgaagcaagttaaactcctcgttctcgtaaacgatcttctttgtcaagccataactattcaagggcttacccctcaaactaaatacagcttggtaattcgggttacggctcttcgtgatagaaccgctagctgagtcgccctccgtgataaagatactgctttcctctagcaaatcccctttcgagtcggtcaggtgaatccggcaatcccttagtttcttattatgtaaattcgctttcttcgcacgctcgcgggccagcttcgtaacaccggcgatcgccttgcgctctttctcggactccaagatcttcttcagtaaaagctccgaagtctccatattcttatgcaaatagttatccaggtcattcttgatgaaatcaccgataaacttcgctaccgtagggccgtccggtcctatatctttcgagccgagcttggtctttgtctgactctcgaatacaggctcctccacttttatgctgatagcggccacgatacccgcacgaatatccgaatactcgaaattcttattgtaatattccttgatgacacggcctacagactccttgaaagcggaaaggtgcgtaccgccttgggtggtatgctggccgttcacgaacgaataatattcctctccatattgattgctatgcgtgataaccacctctatatcctcccctttcaggtggatgatcgggtaaagaggctcggtggtcatattctcgttcaacaaatccaccagaccgttgcgggaatagaaacgcttgccgttgtaaataatggaaagtcccgagttcaagaagacatagttctttaatagcccctcgataaactcgtccttataatgataatccttaaagatctcccggtccgggacaaagaatacctgcgtaccgttcgcctccccggtcggttggatatccgattcctccgtgacgatcgccttactatattccacccgcttacactctccgtcacggtagctggttatcaagaaataactactcaaggcattcaccgccttgatacccacaccattcaaacccacagatttcttaaacgccttgctatcgtatttagcaccggtattcatcttgctagacacatccacgactttacccaaagggacaccacggccataatcccgtacggctaccgtaccttcctcgatagtcacctcgatacttttgccataccccatcatgtactcgtcgatagagttatccagcacctccttcaacaacacatagataccatcatcggcatagctaccgtcccctagttttccgatatacataccgggacgccggcggatatgctccatccagtccagtgtcttgatgtcatcatcgttatattccgtaggttgttgtatcgttgaattcagctcatccatatctcttataactttttaatatacgctcttcttgatttatgatgctctcgcttaaaataatcccattgcgcttgtacggcactattcgtctccagctccgggttactctcggcgtaaacggcaccgatacgcttatagaccggaatcaagtcattaaataataaagcgttcacgcctttactttgatattccggcaagactcctgtcaaatacaggtcgattactttcggcttactcttcaacgctttcagcaaatgaatccacccgaagggtaacagatgcccacgagccttttgcaaggctctcgaaaggttgggcagggagataccaaagccaaccaccgcattatcctcttcccttacgatcagcgttaccaaatcataacgcagcatagggatatacatattgatataataatcgatctgcttctcggtcaatcgtgcgaaaccatacaagggagcgaaagccgcgttcaatgtatggaataccggacgggcgtaaggcataatctccttagcgttcttgaacttcagcaccttcaatccgtatttcttcttcacgatctcaccgatacgcaaatgcttctccggaacgccatccggtatatagatcttaaattcatgccaatcttgatcctttccgtatccgatacgctccacttgcttggggtaatagggataattataaatcgtagccatcgtaccgatctgatcgaaaccctcgatcaacataccctcgtgatccatatcggtaaagcccatcggaccgtggatctcctccatgccttgttcgcgggcccatttctcaacagcgccaaaaagggcatcaaccacctcgtcatcatcaataaaatcaacgaaaccaaagcgggcacgtttctgtccccaagcctcgttactcgggtgattcaccataccggcgatacggcctaccaccttcccgtccttataggcaaggaagtaaatagcgtcgcacacctcgaacgccggatttttcttcttatccagcgtcatcatctcttcctctattaaacccggtacgtgatagggattacccttgtataattcgatattgaacttgacaaacttcttaagctccttcttactggtaacttctcttatctctacgctcatcggtaattttatttaagcggcaaagttacataaataatcttttatcatggcattataaaacaaatttatacctttgtaaactcagattcatagcataccatgaaaaaaatagttattaaattaatattggcatttatcatgtttgaaggaacctcttgtataaacgatcctattataatcagccccgatctggcgtttcgggcggaagctactacaggggagggatcgatttggcatcccgatcgcaatacacttttctgggtagatattgaaggaaagacgttatatgagtatataccggacttgcaaaactgccgttcatggcagttcgaccgcatggtctctaccgtcgtaccggaaacggacagtacggtagtcgtcgctttacaaaacgagatcatacgtgtaaacctaacggatgggaacacgacatctatcgccccaatcccggacaataacgggaagattcgttgcaacgatgggaaatgcgacccgtccggacgcttatggatcggcaccatgggatttggcgcgcctaaaggggctgccagcctttattgtgtatgggcagacggaaccgtcgaaacaaagttgacaaaagtcacgatctccaatgggatcgtatggtccgccaacaagaaatacatgtattacaacgacacacctacccgtaagatcatacgtttccggtatgacgatagctccggtgacatattgtacgatggcgtagccgtaaatatacccgagggcaccggctccccggatggaatgacgatagattgcaacgacaacctttgggtggctcaatggggaggtggcggtgtttattgttacaatccctataccggcgatctgttgacaaaaattgtcgtgccggccccccacgtagcgtcatgcgcttttggaggggataagctcgacacgctttatataacgaccgcccgtgccggattaagcaaggaacagcttgaagaatatccactaagcggtagcgtattctgttgcaagcccggagcgaaaggggtgccggcgaattgtttccattaagaatccgcaagcttaataaatctaattaacacaattgtcaaccaaatatcaatttaaattgtttcctttgtagacatggcgtgcaaaagacgaggtgtgccccgtctccacaaaaacaaatgcaaataattatacagaatggcaaagaatagaccagtaaaaaaagataacaataaggagaaaaaaggaaaaaaggaaaagggtgttggtaaacgtatgaaaaaagaagcgatgatccaagccatcatttccgttttccaatccgctcccaaggaacctttcaactataaacaaatcagcaagatcatcggagtcgagaaccaagtgcagaaattgcaggtggtagacatcctgtatgacttgtccgccgaggatatcatcaccgagatcgaccgtggccgttaccgtctcaacggattgggaaccctagccgtaggaactttcgcacgccgcagcaatggaaagaattctttcatccctgaagacggaggtacgccggtatttatcgctgaacgtaattccgggcatgccatggatggagacaaagtaaaagtacagcttttcgccaaacgtaaaggtgccgagccggaaggtgaggtcgtggaaatccttgagagcaaggagcgtactttcgtaggtaaacttcaagtagctaaaggctttgccttcttgattacggaaaacaagacgttggctaacgatattttcatccctaaggataaactgaaagggggcaagaacggcgacaaagcgatcgtacgtatcgtggaatggccggatgaagccaagaatccactgggtgaggtcatcgatatattaggtatcgccggacagaataccgccgagatgcacgcgatccttgccgaattcggattgccttacaaatatccttcctcggtagagaaagcggcggataagatcccggaagcgatctctccggaggaaattgagaaccgggaggatttccgggggataacaaccttcacgatcgacccgaaggacgcgaaagacttcgacgacgccctttccgcacgccgtttggataacgggaactgggaggttggcgtacatatcgccgacgtaacacattatgtgaaaacggacggtgtcatcgataaagaggcacaaagccgtgcgacttccgtttatctggtagaccgtacgataccgatgcttcccgagcgactttgcaaccaaatatgctctttacgtcccgacgaggaaaaattatgcttctccgctgtcttcgaactaaatagcgatgccgtggtacaaaactcccggatctgccgcacgattatcaagagcgaccgccgctttacctatgaggaggcacaagaggtgatcgaaaccggcgagggagattataaagaggagattctagccttgaacgaccttgccaagaaattgcgggaacgccgtttcaagagtggcgctatcaacttcgaccgctatgaggtcaaattcgagatcgacgaacaagggaaaccggtccgtgtttatttcaaggtttcaaaagacgctaacaagttaatcgaggagttcatgctattggcaaaccgtaccgtagccgagttcgtgggtcgtcctcctaaaggaaagactaagaagacatttgtttatcgtatccatgagcttccggacccagataaaatggagaatttcgcctcttttatccgtcgcttcggctataagttgaaaacagacggcacgaagacggatgtctccaaaggtatcaactccttattagacaatgtacaagggaagccggaagagaacttgatcgagacagtggcgatccgtgccatgcaaaaggcccgttactccacggagaatatcggccactatggcttggctttcgaatactatacgcacttcacctctccgatccgccgttacccggacatgatggtacaccggttgctggaacgttacttagccggaggccgtagcgtgatacaaaagaagtatgaggagctgtgcgatcattgttccagcatggagcaagtcgccgccaacgcagagcgtgcatccatcaaatataagcaagtagaattcatgcaggataagctcggcatggtattcgacggcgttatctccggtgtcaccgaatggggactttacgtagaactgaacgagaataaatgcgaggggcttgtaccaatccgtgatctggatgacgattactatgagtttgatgagaagaattattgtttattgggccgtcgcaagaaacgtcaatatcgtttgggagaccctatcactatcaaagtagcgcaagcgaatctggaacgtaagcaacttgatttccaattagcggaataaggcctttttcaaagtaagtataacttcatcagacaacgaagttatacttacttaggcattttgattatacttactaggacaagtaagtataatttactttttatcaccaatacataagtcccagcgccccacaagcgatcagcccgattcccaacaacgcatagaagatacgtgcgccgccacgaccgaaccagttcacgaaagtcatcgccccgctggttttaaagtaccaatcaaaattacagatcgccgctacgattgagaacaatcccaaagcgataaacaaggataagataaagtattcggaaggatccatagacttacttaacctctacagtacgtgaaccgtccggattctccgagatcgttacatctaccacatctccgggtaacaactcatctattttctccggccattcaataaaacataaagctccgctatagaaatagtcttctgttccgatatcctccgcctcactcaatttattgatccggtaaaaatcaaaatgataaatcaattctcccgtcgtatcgctacggtactcattgataatagcgaatgtgggactgttgatcacatcctccacacccaattcctcacagatcgccttgataaaggtagtcttaccggcccccatcggaccatagaaggcaaagaccgtacgatcatccatcccggcgataaactccttagccgcctcatggatcttatccaaactttctattttcagtgtgctcatagcattcgtgtttacagtttatatggactgcaaagttcgtgatatttatgatatacgcaacttttcggcatattatcatttcggttccatcgtaataaacggcaccaacatctcctccatcgagattcctccgtgctggaatgtatttttataataggatacgtagtagttataattattcggataagcgaagaaattctctccgtaggcgaaaatatacttactgcttagattcggggagggaagccctactttttccgggtcccggatctcaaatacctcttttggattgtagttcaagttcttgcctaccttatagcgtagattggtattcgtattcttatcacctatcaccttgatcggattcgttacccgaatcgttccatgatcggtcgtaacgattacttttcctccccgctcggcgattcgtttgaacaactcaagcgtagaagagtgctggaaccatgatttagtcaaactgcgataggccgcctcgctttgcgccaactcgcggatcatcttactctccgtacgagcatgcgaaagcatatccacgaagttcagcacaatcacattcagttgattacgagtaagagaagggatcgtagccaacaatttctctccatattgggaatcgtgtactttattatatgagaaggtatatttcttacggaaccgatcgatctgggtttgaatcaatggagcctcattcaaattcttaccttcctcgctctcctcatctacccacaaatccggaaacatctgctctatttgcgaaggcatcaagcccgagaatatagagttgcgggcatattgcgtggcggttggcagtatgctataatacaagctctcgtcaaacgtaaaatactcagtaagcaattcttttaccacccgccattgatccagccggaaattatcgatcaatataaagaaaaccttctcgtcattatccaacattgggaagactttcttcttaaacaggtcggggctcatcaacgggcgatcgaccggattctgtatccagtccacataattcttcttcacgaatttggcaaaagcgttattggcctcttccttctgcatacggagcatatctgtcattgccacttggctgctttccagttccagttcccagtacaccaatttcttatagacctccatccagtcgtctgtggtcaaggaatcattgatttgcataccgatacgaccgaattcctgctgataacccaccgtggtcgtctcggagataatcacgttcttatggacattcttcttgatagagagaagcaattggttgggatttaccggtttgatcaaataatccgcgatcttatttccgatcgcctgattcatgatactttcctcctcacttttagtcaccatcacgaccggcacattcggagcgatctccttgatatgcgacagcgtctccaatcctgtcaagccgggcatattctcatcgagaaaaataatgtcaaacgattgttccttacagcagtcaatagcgtcttgcccgctcaccaccggaaccacctcatatcccttgtcctgcaagaacaagatatgtggtttcaacaaatcaatctcgtcatccgcccaaagtactctatctttcttcgctgccataagcttacctagtttatttacaaatatatggataatcctccatataacaacgaaagaaacgggatgtttcgtatttgatctcgtaattttcccaaatccagataagcgaatagccaatgaggagatctccttcatcaactcacgaacagtactctctcttactgactaaggttcaaaaatatccaatttatctacaacatctacaactatccttgtaatcatctatctttagacggtttagcctatggtggtagataaaaaacatctacaattatcaggccctatctaccatcatttactacttttctatctctaaacagaacgatctctccacacttgccgcaatcatcatacggtctcttccttatacagacaaaacattaacatataagcttatacagtttttatccatgaaaaactaaagttttataccgctaaaacctttgttttccgcttaggaaacttttgtttctatatagggaaactaaggtttcttcggcacgaaacttttgtcttctgtaggaatgaagaaaatagttccctaggaactatgttcatgactatttagtgccaaatgccttttatgttaaaactccaaaagataaggcaaatatattgatttcttttagcaaaacacaatcttttctattctaaatcaatattgtcttatattttattgacataactatatgatttcagggcataaaagtcccaccggttagtctatttacgctctgtagatacaatatgtgaattaggaagaagcgtagtttgtaaataccgaatatagttcctagggaactttgaagaacttagttttacttcagaagtcatgtaatcttatttttattactcagcttataatggcaaaagacaattttaacattatttacgaacgaaactatcaacgatcgttcatgttcgctaaatcatacgtacatgatgatatgatagcagaagatatcgtatccgattctcttgtgaagtattggagactgatctccacccaaaaaggagaagcaacagaagctcttttactttcgatcttgagaaataaagctctcgactacttacgccataaagctgtacatgatgctgcgatcgaaaatctagaagaaataaaaaagcgagaactaagcatccgcatatccactttagaggcttgcgatccagaagaaattttccgggaagagatacgcacaatccttcagcgcaccctacaatcattgcccgaacaaactcgcaggatattcgagatgagtcgtttcgaaaacaaaacagtgaaagaaatcgctatagaaaccaacctcaccgtaaaaggagtagaataccacattaccaagactttaaaagtattacgtatcaatctaaaagattatcttcccttattctattttcttttttcttgacttttctcgtttttccactagggatctatcttgcagcatcgtttattatttataaagcgaaattaatagataccatgaaggaattactacaacgatacataaaaggagaggtttcagagaaagaaagactgaaaatagcatcatggttagacgaaagccctgaaaacatgcgtgaatttctggttttacgcaaattatatgacatttcactttggcaagccaatacagataagacaaattccgtaaagaaagtacattattccatacggaagataatggccgagatcttaaaaatcgcagccatctttctaatcggcttttggggaagcaaacaactgcagatacaacaatcgaacaagaaacaaatgcaaaccattcatgtccctgccggacaacgggcagaggtcaccttagccgatggtacgcatgtatggctaaactctcgctcaaccctaaaatttcctgaacaattcagcgcaaacacccgaaacgtggaattagacggcgaaggttacttctctgtccagcacaatgaaaatagtccatttaccgtacatacccaaaatcatgatgttcaagtattaggtacagagttcaatgtaaaagcttaccataacacatccttgttcgaaaccgcccttttaaagggtagtgtaaaaatcagttcccctaatttaagaaatggattacaactcaagcctaatgaaatcgttagtatagagaataggatgctcaagaaatctacaattaataatagcgactattttaaatggaaagaaggcctgttctgttttgagaatgaatcaatccaagatctaataaagaaactagaactttattatgatactacgattgagatccaacgtccctcattgttgaaacatcactattccggcaaatttcgtattcaagatggaatagagcatgtattaaaagtacttcagttaaaacataaattcacatacatcaaagatgacgataagaatctaataatcataaagtaagaacagaatgttaaccttataaatcatgtatgcctatgagataaaaaatatcaaaaaagaaacggtatataaaaaccgggaaatgcggcaacactccccggaaagaatcaataccacatgcacttaaatcatcagtatcaaattcaagagttacaaatgtatgaaaaatcaaacaaaaagagttatgaagttaacttttataacactatttctatcaaccacaggaatgtttgcatctgttaattcgcaaaatacacgggtcaatatccatgtgaacaatgcaaacactcaaattgtcttaaacgaaatcgaaaaacaaacagactatctctttgtgtacgacaccaaagaaatagatctaaatcgtaaggtttccgtagaggcgcaaaataaaaccgtagcagatgtgttatcatctgtctttacccaaacagacatctcatatgcgatggagggtaataacatcatgttaatgcgaaaaaacacttctgttacacaacagagtaaccggagaattaccggtgttgtgaaagacgcaattggtgaacctatcattggagcaaatatcgtggtgaagggaaccacaaacggtataatcaccgacattaacggaaatttcagccttatggtctccgagaacgccatcttgcaaatttcctatatcggatatcagacacaagaaatccctaccaaagggcagacgaacatccaaattaccatgaaggatgacgcacaagcattggatgatgtcgttgttatcggttatggtacgcaacgcaagaaagacgtagccggatctatctcttccatatctacgaaggatttatctattcaatcatccgggaatatacagaaccttcttcaaggtaggttatccggtgtgtccgtaacaacttccggcgtagctggcgatgctcctgctatccgtattcgaggtgtcggaacactgaataataacagcccgttgtatgtcattgatggttttcctacaaaaagcgagatcgcatcccaaataaatccttcaagtatagagtctgtacaagtattgaaggatgcttcctccgcctctatctatggttcccaagcagctaacggggttatcttaatcacgacaaagcaaggtaaagaaggaaaacctaccgttgacgtaaaagtaaacgtaggcgtgcaacttcccaccaacttgccggaaatgctaaactcccaacaatatggagaagtcttgtggaacgcaatgagaaacgccgggttaacaccacagcatgaccaatatggcaacggagctacacctgtcattcctgattatattctaccggcaggagccatggaaggccaggtagatctcagcacttataatactgcggaaaatcaatttatgcgcgctaataagatcggaactaattgggctgatgaagtttatcgccccgcaccgactacaaacattgatatcagcgcacaaggaggtggcaatgggtctaaatatttcttgagcgcaaactattataaacaagaagctcttgtaaaatgggcgggctatgatcgcttctctttacgagccaattctcaatttaagattttgagcttcgccacattaggatcaaacctaagcgcaacttactctaaatacaaaggaagcaaatcagaccatgaggccgtacgtatggctccgcttattccggtttacgacgtagaaggtaattgggccggaacaaaagctaatggtttaggtgattccaagaatccggtagcccaactttataatcaaagagagaattacaatgacaacctcaacttgttaggtaatttgtatttggatatcaatttcttgaaatacttccaattcaagacaaatgtcggcgtaaacgttgaggatagcggctccaaagagttcaatccaaaaacttattggaacaaaggagacgcaaatacgctagtgaattctttaaaggaagcaagaggccgtaaatcagaattggtttggaacaatactttgaccttcacgaaaaaatttcgtgaaacacataatctgaatgttttgctaggtacagaagccattagttctaaaatagagaatctctctgcttatagaagtaattttattatcgaggatcccgattatagataccttgacgctggcgaatccaacaaggacaatacaggcaacgcaaatgaatacgctttgttctctctgttcgcacgtgtcaattatcaatataaagacaaatattatttaggggctattattcgtcgagatgggtcctcacgttttggtgcgaatcatagatatggctacttcccaggggtaaacgccgcatggagacttacggaagaaaacttcatgaaagggcaagatattcttagtgatttgaaaatcagagccagttacggtttgacaggaaatcaggatatcgataactacgcatttgcgtccatgtattatacgaatatctcaactagcagctatcctatagcgggagatccaaactctgtcactcaaggtatcagtaaggagagcattggtaatccggatcttaaatgggagacgactacacaaacaaacattggtatcgacgcaggtctttttaataataaactgaatttgtcattcgatttctaccataaatatactaccgacatcttgcaaagaattacttatccttctaccggaggagtggcaagtgccccatttatgaatatcggtgaaatgcaaaataatggatatgaattgaatatcaatttccagaatacgacagactatggtttccggtacgaattagggctcattttgtccggatatcgtaatgaggtaaagaaattagcttcaaatcaattcatatcgaacacatatacaagaacagaagtaggtcatccgatttcctctttctatggctatgtgatcgatggtattttccaaacacaaggcgaggtcgactcgcatgtagaacagtcagacaaagcaatcggccgttggaaatatagagatgtgaataatgacggaaaaatagacagccaagatagggcctatatcggtaatcctcaccctgatttcgagtactctttgagttcacgcttctattacaagaacttcgatttgtctctttatatccaaggcagtcaaggaaatgatatttgtttcgcatcgaaaggcggtagggatggccttgatttctggggagattatttcaataaaagtacccgtatattgaatacttggactcctgaaaacagaaatgcggaactgccggagatcaatatcttgaatccaaatgatgaggcaggtaaggtttcttcatacttaattgaagatggttcttatattcgtttgaaacaattagaattaggatatacccttccaaaacaaacgctttcgaaaattggactccagcaatgtcgtgtttatttgaatgcggaaaacttattgacattgacaaagtataacaacattgatcccgaggttaagaacggcgatgacaagaatatgggtgtcgattatatgaataatatgccactagcacgcgtattctccattggtttcaatttatcattctaatacttaaaattaaacaaacatgaaaaatctatttcatatagcgaaaaaaacgttcacatgggtaaccgtcacgatggctgttagcctgtttaatggttgttctgattttttggataaacaaccattaggcaaattgaatgagtctgtattaacagatgaaagtaccgtgaataaactccttattgcctgctatagtccattaaacggatttatcaacggagtttggggaataacaagtgggccggataatgtcttctatggagatatgtgcgctggaaatatccataaaggaagtactaccggcgatcaaggcgaactgctacagatggagcgttatgtcgctactgctgaaaatggtcgtatccgggataaatggatactggtatatggagctattgagcgttgcaacgacgtacttcgtatgctgaatgataataaaattgatggcttatcagaagaaagtgaaatggaaattagagcagaagcccgtttcctaagaggatattatcattttgaagcgaaaaaaatctggaacatggtcccttatattgatgaatacgtagaagatccgcaaagaagggttcccaatgacaaagatatttggcctaatattgaagaagacttctcttttgctaccggaattttaccggataatcagagtgagcctggaagacctacgaaaaacgccgctaaagcgttcttggccaaggcttatttattccagcaaaaatatagcgaagcaaaagttttattagacgaagtcatcactagcggaaaatataagttacttgacaattattttgataacttcaatgcggagcaaaacaataacgcagaagtggtatggtctaaccaggtagcggtaaatgtagcgggagctggttacgatcgtagccaacgtggtttcgacttatcttatcccaatgctccagatcaaccaaacttaagtggagccggattccaacaacctactttcgacttagtgaatgcctatcaagtagacgaaaatggcctacccatgattgacacttacgctgaccatgaattcaaaaacgaccaagatatcgaatcaagcgaggcatgggaaccagatatggaaacccctgtagatccgagattagactgggtcgttggtcgtagaggcattccatatcatgattggggattgcacccgggaaaagcttggatcagggatcaagtcagcgcaggtccttataaccaaaagaaatggattatattagaaagccaacttgctacatacgcttatgacaatacagcaaaatttaacgcaatgaatttcaatattattcgatacgctcaagtattattgtgggcagcggaatgtgaggtggagattggtaaccctgagaaagcaaaagaatatgtcaatatgattcgtcaaagggcaaaagacggatcttacgtgagattaggagatgaagcaccttttggcaatggtccagctgccgccaattataaagtggatatctataaggattcatgggcaggactaagtaaagatgtattacgaaaacgtgtacgatttgaagaacgcttggaacttgcgttagaaggtcatttcttcttcgatttggtacgttgggatatcgctgaggattttttaaataaatatgtcgaaagagaaaaaagacatatccaatatttaaatggagccgtttttgataagaaccatcgctattacgctattcctctaactgaaatagatagaagctatgtcgatggtaaaccaacattgacacagaatccgggatattaattatagtaagtgtgagggggtatcataatatcccctccacttttatctacaaaagatttgaatatgacgcaatatctaaagtcactttatctatgcatttgtttactggggggatttatatcttgtcaaacaaatgaaagtatcactcaagatgaggagatacaaacaatcatggaaggaatctcgaatcaagcgggtcaagaaaaaaatccttatctgacagcaggagataaaacctacataataggtacgcaagatggaaacttccctgatcttggtggacatactcccggagagatgggaggagtttggaatcatttgatcaagctattagatggcttttgggtaaaaatgacagataataaaggtaattcttgttggttggaaaacgcaatacaatatacgaattatccttttggaagtaaatttgagtacgctcctttatttaataatagtatccgtgtcaatcgtttccaattttgcccacaaggaaaaaatggtgttgttattacctataccatcgaaaatgtatcggattcagagcaaacggtcctttttgattttgtcgcaaaaacagatttgttgcctgtatggtcatccgggacaatcgggttaaaagacgcaaatgatgtcgtgaactgggatgcccaagatgccatttttaaagcgaaagatttaggtaataactggaacgtgatttggggagcggatcaacatacgagtatttatcaactagatactcctacttatataaatacgcaaggaacgggtaaaagtgcctcttctacttatacgattacacttcctaagaatcaggagaaaaaactttctttcgtcatcgcaggatcaaaagacagtgaggaggatgccctaaaaagttacaaagacatcttagcgaaccattccgaaatgttggaagataaaaaaatgtattacacccaactattagagagaggacggattaacattccagataaaaagttacaagaggtttataactggtgcaaaatcaatacggaatggcttgcggcagatatggaaagtgcaggacgctttctgggagcgggcgcaattgaatatccatggttattcggttgtgataattcttattcattacaaggccttgtcgctacaggtgaccaaaaattagcaaaagagacattgagagttatcaaagagatgtcagagaaagccaataggaatggccgtattttgcatgaaatggcattcaacgcattcgtcagccacaaaggaaatactcaagagactgctcattttgtcatcgctgtatggaatgtttataaatggactggtgataacaaattccttgcagatatgtatccttatatgcaaaaaggtctgaacttccttttgaaagatatggatacaaataagaatatgttccccgaagggtatggaatcatggaagttagaggattaaatgcggaattgattgatgtctctgtttatacccagcaagcactggaagttatgtcgcagattgccttaataatgggagaagaagcatttgccagtgagtgcgcctcgcaagcaatcgatttgaaagaaaggataaacgacctattttgggataaggatttagaaatttattgtgatttttatggaacgagagagcaagccttagaaacgactaaaggtgctatcgaacaggttcgtaatacagaatacaggtgggatgttgccgaggtttccttacaggaatatgaggatagcaagaaaaagcatatcgcaatgtatgaggatatgtataaacaatttgaagcgtatccaactggtattatgaaaggatggttaactaacaagaattgggtaataagcactccaatagaaactcatattgcctcagaagacagagctattcggcaattggataaagtacgaaaagagcattgcggcgaatatggtccttatttatccgcagtcgaaagagatcgcatgatgactatcgcaacaggcgtacaagcgatggccgaatgcgcttacggacgtgtagatgaggctttatggtatatcaatcgcatcgtcgatacatttggccgtacacttccgggatcaattaatgagatgatgcctgattatggctgccctgttcaagcatggaccatctatggtatagcaacacctttgattcgttatatatatggcatacaaccagaagcctataaaaagaccttgaccctaagtcctaatttaccatcagattgggactttattgaaatgaaagatcttcctgttggaaataataagattaattataaagtaaaacaactggaagatggattggaaatcacgttagatacaactgaaaaggattggagttacctattaagaccggtaaaacaacctatcaagcgatttatcgtgaatggtaaggaacaacggatttagagagagacggggcatgccccgtctccacatatagacaccgcctcataatgatctaaaattaaaacagataaccccaactattttgagtaaatagaacttagtctgaattccgtattcaagacctctttccactctaaccttttactatcaatgcgataaatggataacaatcaatttctttcatcccatattatacttgagataaccggaaagcggggaaaatgaaagtatgattactttaactatttttctatcaaaaattcctacttttaccgctaaatctgtattgaagatgaaaggagacgattttaatatcatttatgaacggaattaccgacggtcattcctgttcaccaaatcatatgtacatgatgacatggtggctgaggatatcgtagctgaatcgcttgtaaaatattggcgactggtctctgctggagaaaacgagataacagaagccttattgctcacgattttgaaaaataaagcccttaactatttacgccataaagccatacatgatgccgctattgaaaatttagaggaaataaaaaatagagaactaagcattagaatttccacactcgaggcttgcgatccgaaagagatcttctctgatgaggtcaataggatcatccacaaaactttaaaaaacttaccagaacaaactcatcgaatattcgagatgagccgcttcgagaataaaaccgtaaaagaaatagcggatgagacaaacctcaccataaaaggtgtagaataccacataaccaaggctttaaaagctttgcgtatcaacttgaaagactatctacccttattttattttcttttttcttaatttttttcatttttccactagggatttagcgcacagcgttgtttttataatagaaaataaattaacagacattcatggagcaattactacaacggtacataagaggtaaggtttccgaagaagagagactgaaagtagtgtcatggctggacgaaagtcctgataacatgcgtgaatttctggctttacgtaaattatatgatatttcactttggcatacggatacagagcaaaaaacacttcataaaaaattcattccaacaattcgacgtatcgcaatcgaaacactaaaaatagcagcgatctttttaattggaatctttgttactaaacaattcgtagaacaaaaggtagaggatatacaaatacaaaccatccatgtacccacaggtcagcgagctgagttaactttagcggacgggacacatgtttggctcaactctcgctcgacattgaaatttcctaataaattcggcacaaataaacggaacgtagaacttaacggagaagggtatttttctgtacatcatgacaaaaaacgtccttttaccgtacaaaccgaaaaatacgcaattcatgtattgggtaccgaattcaatgttaaggcatatcacaacagtcctttatttgagacagcattattaaagggcagcgtagaaatctcttcctcaaccatgccgaagagattacgcctaaagccgaacgagatggcgatcgcaagtcaggaaggattaaatacatcctacatccccgaccacaattactttaaatggaaagagggattattctgtttcgaagacgagtcgatccaaagtttaatagaaaagctacaactttattatgatattaaaattgatgttcaacgaccatccttacttcaataccgttattccggcaaattccgtatcaaagacgggattgaccatgtattgaaagtattacagttaaaacacaaattcacttatacaaaaaatgaagagacgaatctaatcgtgatagaataaatatttagtcgttaaccttttaaatacaacagaatatagagaatgaagacatgacaaacaattaacagcacaaatttcacaaaaagggagatgctgcaacatcccccttccgtaagtcagtaccagacttgcgaaaataaattcatttagtactaacaaataagacattacaaatgtatgaaaaaaatttgtaacgggcattttatgtccccttttaacacagaagataaaacatttcgaataatgagattaacattcattgcattatttgtattcagtttcagcttactcgcatccgtacattcacaaacgatgcgcgtcaatatcaatgctaataatgaatctacgcattctattttagaacagatagaacagcaaactgattatctatttatttataacacaaaagaaatcgacttaagccgtaaagcatccgtacacgctcaagaccaaacggtaatggacgttttgtcacaaattttcagaaacacggatattggatatgcgattgagggcagtaatatcatgttgatgaagaaagatgaaaaagcagaaaaacaacaggacaacaataaggtctcaggaacgattacagacaaatcaggagaacctattatcggcgctaacgtcgttataaaaggaacaaccaacggaaccattacagatatagatggtaattatgcgttagatgttcctgtttctgccatcttgcagatttcctatatcggatatttgacacaagatgttcctgtaaatggaaaacaacaaatcaatgtccgtttagtagaagatacgcaacaattagacgaggtggtagtggttggctatggtacacagaaaaaaggggaattaacctcatctatttccagcataaaaagcgaaacattcattcaaggttcagtacaagacgcagcccagttgcttcaaggaaaggttgcgggacttggtattgtcatgcctaacggtgatccgacgtcttcatcccaaattgtattgcgtggtatcggctcactaaaaggagaccgggttccattagttattgtcgatggagttccgggtgatatgagcactgttgcaccagaagatatcgaaagcatagatgttataaaagacggctcagccgccgctatttatggaaccagaggaaataatggcgttattttcatcaccacaaaaaaagtgaaaggagaaatacctgtgactattgatattcaagcctatgtcactacccagcaaatcaaaaaaagattagatatgatggatgccaatcaataccgtcaattagtaaaacaagggaaacccggcgctattgattatggttacgacacagattggctagaccagatattaaggactcctatttcttacgtaactaatgccagtctacgcggaggtaatcgcaactctaattatatcgcaaacataaactataagtctggccaaggcattatcaaacgctcagacaatagagtattaaccacacgattggaaatcaaccattctatgtgggataacttattgaagtttaatttaaacatcatgggtaaagaacaaaaatatacagccttaggagatggcaaaagcttcaatggggagatttaccgaaatgcgttaatcaatattccaacagaacgttcgaaagacgataacggaaactggattgagcatccgacaatgaacggatatatgaatccggtagctgcgctatatgaaagtaatggcgagaataaaagtactcaattacgtacattcggaaccgttacattgactcccatggatgaatttttcgtaaaagcattagtgtcgagaacctcttataatcaaacccgcgggtatgctgaaactaaaaaacacatatcaactgtccgcaatggcaaaaacgggtttgcttctcgcggaacaacagcttctatcgataatctgttagagatcacagcccaatacaaaaataattttggtgctcataaccttactggtttagcgggttattcttatcaagacaatacctatgaaaattattggatgcaaaactgggattttccatccgatcaatatagctataataatatgggggctggagctgccttaaaaagaggagaagttgaggaaaagtctgaaaaaaacaagtctaagttaatcggtgtatttgctcgtatcaactatagtttcaatgatcgttatttagcatctgtcagtatccgtcatgaaggagctacacaattcggagctaattataaatggggaaattttcctgccgtatccgtaggttggaatatacataatgaggacttcatgagctccttacgttttatcagtagcttgaaagctcgtttaggttttggtgtaacgggttccattcctgaagatccatatatgtcattaagccgcttgaccagcgataagaatctctatactggttctggctggctcccttcattaaaaccttcaagtaacgcaaatccaaacctgcgttgggagaaaaaggaagagtggaacttaggaatagactttggtgtccttgagaaccgtatcagtggatctatagacttttataaacgtacgacaaaagatatgctatggaactatcaagtcgccacacctccttatttatataaggaaatcctcgcgaatgcaggaactatgcaaaataaaggactagagatacacctcagtgcaatcccagtacaaacaaaagaattctcatggacaactagctttaattattcaaccaacaaaaataagttggttgccttatccaacgaggaattccaattaaaatccggttatatagaagatggctggactggcgaacctatccaacaatatacccatcgaatctttgaagggggtgaggttggtaatttctacggttttaaaactattgatatagatagcgaaggacgttggattattgaagataaaaacggtaatccaaaaccgatctcagagcaacaagcagaagataaaaaaattattggaaatggcctgcccaaacacctattaagctgggataacagttttaccttcaaaaatttcgacttaggtataactatgcgaggtgcattcgactatgacatcctcaactacccccgcatgttttatgaatgtcctgtaaacttgacccggggaaatttgcttgccacagcttatgaaccgaagtacggaaagactgtactaaacgaccaacaggaacttcaatatgttagctatttcatcgaaagaggaaacttttggaaaattgataatatcaccattggttatactttaaaacttaagaatgattatttaaaaaggatacgtatatacgcaaccggtaataacctattcacatttacaggatacagtggattagaccctgaggttaatacgcaaggacttaatcccggatgtgatgaattaggccgttacccttctacacgttcctttactttaggcgcaatgtttactttttaaaataaataaactcatgaatacaattaaaaaacatataaatatcttattattaggttgctgttcattgaactttatttcctgcacagacctaaccgaagaaatcttctctgacattactgaagatagttataaatatgaagctggagacgcgactaaagtggttggtgccgcttataccaatcttcaagattggggatattgcggttccggacaagctccaatgctgagtcaagaaatatgtaccgatgccgcagtgttccccgctaatggttccggttgggatgatggaggtgtatttcgtagaatgcatcaacattcatggaactccgaacaattacaagtgaatcgtttatgggaagtttgctattccggaattatcttggcaaaccgggctatcagcattatcaaccaagatgattttccttttgccgcaaatgaaaacaaggctgccatgatcgctgaatctcgagcattacgtgctttctattactggtacatcatggataattttggagatgctcctttagtaacggaacccacctcagaattacctgtaaaaacatcccggaaggatctttatgattttatagtcaaagaactgaaagagtctttcagcgatctcccaacagagaaaaatgaatctaattatggaagattcacattatggggagctaaagccctcctcgctaacgtatatttgaacgcagaagtatatacaggtgatccccaatggaatgcttgtattcaagagtgtgatgatattattaattcaggaaaatacagtttagacattaattatagcgatccatttaaggcacacaatgaaaactcattagaaaatatattagtcattccctatgatgaaatatttgccactggatttaactatcatttagccgccttacacggagcaaaccaaaaaacgtatgatctagttggaagcccttggggagctggggcttataaaggaatacctcaattcatcgacacctatgatccagatgacgaacgtttaaatgccacttggctaggaggtccccaatacgcatctgatgggacacctcttacaggctcttatgacttaatgggacaaccgcttatcttcgtcaacaaaatgcccaacggtattttcaccggtgaggcagaaggatatcgctggttaaaatatgaggttgagctggaagccagaagtgaactaaataatgatttggtcttattcaggcttacgcaagtccatatgatgaaagcagaatgccttttacgtactgggaaagcagatcaagcagcgtctattgtaagtatggtcagaaaaagagcttttaaagaacatcctgaaaaagcaattgtctcaggagcgcaattacaagaaaaatcctgttacaaatacggtacggtagaaaactatgtattaacttcgcaaaatcaagtttatccagaaaaattcggacgtttctatgatgaactaggttgggaattcgctggagaatcttatcgccggagagatatgatacgtttcggtcatttcacaaaagctaaatggttatctcatgagccgaatggagattataaaacggtatttcccttacctcaaaaagtagtagataccaatccgaatctggaacaaaatccgaattatcaataataacatagagggtatgtctctatattgacataccctcctttaatctcaatttctaaagctatatgaagcaataccttttactcgctgcgtctgcctttcttttgcaagggtgccagacctctaaagaagatataaaggaacagcctttgaagatgatcgagcagatcgatttctctcatgtgaaaatcaatgacaacttttggtcacccagactcagcaaacatgtctcggcgaccttgcctgtctgtatcgatcaaatagagaatcaaaccggacgtatccgtaatttcgagaatgcagcgaaaggggaaggagagcattccggcattttctttgatgattccgacgtatataaagcgttagaaggtatggcttatagcctgatcaacaatccggatcccgagctggaaaagaaagcggacgaatggattgataaattcgctgccgcccaacaaccggatggctacatcaataccttctatacactcaccggattggataaacggtggaccaatatggacaagcatgagatgtactgcgccggacatatgattgaggcaggagtagcgtattatcaagctacaggaaagcgcaagttattagacgtatgtatacgcatgacagatcatatgatgagccaattcggtccgggaaaaagacattgggtaccgggacacgaggaaatagaactggcgcttgtcaagctttatcaaaccacccaagagcagaaatatctggatttcgcttattggctgctggaggaacgtggacacggtcacggcactatgggtgatgaaggtaaatggaacccggtttactatcaagatatcgttcccgtccggcaacttaccgatatctccgggcatgcggtacgatgtatgtatttgtattgcggtatggccgatgtggctgccttgaagaatgatacgggatatatagccgccatggatcgtctatgggatgatgtggtacaccgcaatatgtatatcaccgggggaatcggttcatcccgggataacgaagggtttacggaggattacgatttaccgaacctagatgcttattgcgagacttgcgcttctgtcggaatggtgctttggaaccaacgtatgaaccaacttaccggagactctaaatacatcgacgtactggaacgttctttatataacggtgcgcttgccggtatctccttgggtggagaccgtttcttctatgtcaatccgctggaatctaagggtgatcaccatagacaagaatggtatggttgcgcttgttgcccaagtcagctttcacgcttcttgccttctatcggaaattatatctacgcctcctccgatgatgcgttatgggtaaatctatatatcggaaatacggggcaaatacggataggagagacggatatcctattaacacaagaaacggactatccgtgggatggatcggtaaaactaacaatttctacttctcagcctttggagaaagagatacgcctccgcattcctgattggtgcaaaacctatgatttaagtatcaatggcaagagaataaacgtgcctaaggaaaaaggctatgcggtaatcaaggattggaaatcgcaagatgtaatcgctctagatatggatatgcccgtggaaattgtcgcggcagatccgcatgtcaaggaaaatttcgacaaacgggcgattcaacgagggccacttgtatactgcatggaagaaatagacaacccggtatatttcgatcaaatacagttgagcccaagtacaacattccaaacagccttcgcttccgatatattgaatgggataaaaacaattaaaacaaacggtagggcacaatctgctacctttattccctattacgcgtgggataaccgtaaagcaggaaaaatgagggtatggatcccctataacgaataactaaaaaagcatcaaaatgaagtatttattaacgataacattatcaagcctaatctcaattacctccttttctgccactttgctgggaaatgaaggttctatcaacattaattacccgaacaatcgttatccattagcctctaagccttatatagagttgcctattggggatgttaaacctgcaggttggctaaaaatccaaatggaacgaatgtgtacgggaatgaccggccatctggattctatctatacgaaagtaatgggaccgcgtaacggttggttaggcggagatggagacgtatgggagcgaggcccatactggatagatggcttactacctttggcttacatcatgaatgatgaggccctgatccaaaaagtaaagccttgggttgaatggacattggcctctcaaaagcctaacggatatttcgggccagatacagacagagactatgaacccggcttacaacgggataacgcacaagattggtggcccaaaatggttatgctcaaagttctgcaacaatattattccgctaccaacgatcaaagagttatctcgttcctcactaattatttcaaataccagctttctgaactacctaaaagtcctctgggaaaatggactttctgggctgaacaacgaggaggggataatctgatggtcgtatattggctttataatatcacgggcgatcctttccttctggagttaggagagttaatccataagcaaaccttcaattggaccgacgtgttcttgaaccaagatcatttagcccggcaaaacagcctgcattgtgtaaatctcgcccaaggattcaaggaacctgtcatttattaccaacagagccataatcctcaaaatctggaagcggttaaggaagctgtacggaaaatgcgccatacgattggttttcctacaggattatgggcgggagatgaacttttacgtttcggtaacccgacacaaggatcagaactctgtaccgctgtcgagatgatgttctctctcgagaaaatgttagagataaccggagatgtccagtgggctgatcatttagagaaagtcgcatacaatgtactgccaacgcagatcaaggatgacttttccgcacgacaatattatcagcaagtcaatcaaatagcgatcacttgcgaaggacgtaactttgtctcaccacacgaggacacagacattgttttcggagaattgagcggttatccttgttgtacctccaatctacatcaaggttggcctaaattcacacgacatctatggtttgccaccgccgataatggcatcgcttcacttatctacgcaccatcggaagtgactgcccaagtgggaaacgacatcacggttaaaatcgcagagaaaaccgattatccctttgaagaaaagatcgatttcaatttatcgttccctagcaagaaagacaagaaagccttttttccttttcacttacgtattcccgcttggtgcaataatcccgtgattacgataaatggcgaggctgtctctatcgcagctcactctggcgaaatcgtacgaatcaaccgagaatggaaagatggcgatcatatccagctagagctacccatgcgtatatccacaagcaattggtatgacgatgcggttgttatcgaacgaggcccattattgtattccctaaagatggatgagaaatgggaacgcaaggttgatcaacgcccggagtcttcacataaaggagaatggtattatgaggtcacctctacttcagcatggaattattccctgattcgcaaatatctgaaagaagaagaactagagaaaaatttcgtcgttagaaaggcagagaacatagccccttacccatggaacctagagaatgcccctatcacgatcaaaacaaagggacggatcttaccttcatggaaaatgttcaaaggttccgccggccccgtaaatttcttcatgcaagccaacgaaccgatgggtgatgaagagacgatcgagttaattccttatggctgtactactctacgtataaccgagttccctgtccgatagaataatgttaataatgtgccaattgttcaatgtgccaatatgccaattccgattcaatacggaaagagtatccacattggcacattgacacattggcacattattaacattattcaattttttttcattgtatagtctttcacccccaaggaatcatacgcctgcaaaagcgcctcgtcattatcggagatcattaacaacttgtcgttctcctttaattccgtatttcctttcgggatgaaatagcggccttcccgtttcaccattaccgccaaggtatgatcgggtaaagtcagctgcatcaatttatttccatgggataataccgccggggtaatatcgatctcgctcatagcgctcttgatctcctcgggaagctcgatgccaaactcatcctttcgttccggctcatccaccatatccagccatttagcggcttgggtaaccgtggttccttgaatcagcaaagaaagaatcgtgataaaaaatacgatattaaagaacataccggcatgctcgatcccggcgatcatcgggtaagtagcgaaaataataggaaccgccccgcgtaatcccacccatgagatatacagtttacctttgaaggagaaattcttataaggtatcaagcaaaggaacacgctaatcggacgggcgatcaagatcataaagactcccaccataacacctacacccgtcaccggtaataactcatgcgggttcactagcaagcctaacgtaaggaacatcacgatctgccacaaccaagcgaaaccgtcaaagaacgtccccatacttttcttgtgaacaatcttagcgttaccaaccaccaaaccagcgatataaaccgctaaatagccattacccttacataaggtcgtagcggcgaaggtgaagaaagccgtagccaataaaaggatcggatacaaagactcgttatctatatcgatcttattgataatcaacacagccagtctccccaataagaaaccggcgatagctcccaccgataattgaatgaccaaggatagcccggcctcccaaatattcatacctccgctttgtatgtaagcgatcagaagcaaggtaagcatataagccatcgggtcattactaccactctccagctccaaggtaggacgcagacgctctttcaaataaacccctttactgcgcaagatggagaaaaccgaggctgagtccgtagaggacatgaccgccgccagcaataaagattccgggaaagtcaacgtaacatatttgccaaataaaccaaataaccaatagataaacccgcccgtgataaaggtcgtagccaacaccccgagcgtagccaataccacaccttgcgaggcgataggtttgacctccgcaactttcgtgtccataccacccgagaacaagatgatactcaacgccaacatgccgataaactgggctacattcggatcgctgaactggatgcccagaccatcgctgccaaacaacattcccacaccaaggaacaacaacaaagcgggtaagccgaaacgataaccggccttacctgcgaatatactaaaaaacaggatcaccgaggctattaatagcacttgctcaggattttgaaacatacgcaaaacgggttttatgattagtgatttgatactttgtcacaaagttcgtaaacttttcgcaattataatcacacaaaaagaagaaatccggtcccaaatttacaggaagaccagatttattctttctatagaaaaacaaatctttcttacaaattgttcgagaatttttctatctcgcatagaatcattacttttggcaaacatacatatccgctttatgaacaaaaaacatctatttgcgctgttgttcacattactcgtatggacgagctgtaacaaccaacaacattttattaccgacgccgcttaccgagctgaggttgagaacgatttccaagcgaaacaggccgctctgcctaacggaaaccttttcgcagtatttaacgatcaaatgactcccgaagagagggaggcgttaaccttcatgtacgcctatatgccgattggagacatcacggactatagtggcgatttctatttgaaaaacatccgttcctctttccaagcacggaatgagatgccttggggcgatagcatcccagaggatatcttccgccatttcgtattgccggtacgaatcaacaatgagaatctggatgaaagccgcatggttttctttgatgagttgaaagaccgggtgaagggtctctcgttgtacgacgccgtactggaagtgaatcactggtgtcatgaaaaggttatctatactccttccgatgggcgcacaagttcccctttggcatccgtgaagaccgcctacggtcgttgcggcgaggagtctaccttcacggtagccgctttacgttccgtgggtatccccgcgcgtcaggtatatacgcctcgctgggcgcatacggatgataaccacgcatgggtagaagcttgggtgaatggtaaatggtatttcttcggcgcttgcgaacccgaaccggtattgaatctgggttggttcaacggccctgcttaccggggtatgttgatgcatacgaaagtattcggtaaatacaatggcccggaggatgtcatggaacgtaccgatgggtataccgagatcaacgtgatcgataattacgcaccttcggctaaagctgttatcacggttacggatgccaatggcaagccggtaaaggacgctttggtagaattcaagatttataactatgccgagtttaacagtgtagcccgcaagaagacggacgcggatggcaaatgctcattatccgccggaaaaggggatatgctggtatgggccagcaaagacggcaagttcggctacagcaaggtctctttcggcaaggacggagaggttacgatcgccttgaataagaaaccgggagatgtggagacgatcgccctagatatcgtaccaccggtagacggctctatccccgcagaagttacaccggagcaaaaggaggcgaacgccaaacgtttattggaagaagacgctatccgtaataaatatgtagctactttctatacggaagagaaagcagaggctttagcgaaagaattgggtatcgacccgatgaagacagaggatttcatgatcggtagccgtggtaactggatggagatcgagaagttcttacgggagactcccgccgagaagcgtgtgcaagcgatggctttattggatgtcgtatccgctaaggatctacgtgatacacctgcgtctgtctttgcggaccatttaaacaatacgccggccgttcaaagcgaatggttcaatgaatatatcatgaatcctcgtgtggccaatgagttcctgactccatataagagtttcttcgctgcaaacattgagccttcccttgcgaaacaagccgtagagaatccacaggcattggtggattgggtgaagaataacgtctccattaacgatgcgctaaacgcacaacgtattccgatcatgccgatgggtgtatggaaatcccgtatcgctgataagggctcccgtaatatcttcttcgtggccgtggctcgtagcttaggtattccggcacgtatcgagccggtagcccgcaagatccagtacttcaaggacaacgcttgggtagacgtcgatttcgaggctgccgtacagacgaccgctaaacaaggcaaggtaatcgcttcttaccaaccaatcaaggcgctgcaagacccgaaatattacagtcacttcacgatcgccaaggttttgccgaacggtactttacagaccttgaatttcgagagaggcggtaatgtggatatgggcttgggagatacttggagcggattactgaagaaaccgttatccatggatgaaggtaattatatgttagtgaccggtactcgtatggcaaacggtagcgtattggccgagatcgagtttttcaatgtggaggcggacaagaccaccccgatccaattggaaatgcgtgaaagcaaggacgagatacaggtgatcggtaatttcaactccgagaataagttcaaacgtgcggacaacggtgaggagaccagcctgctagctactaccggacgtggctactatatcgtagcgcttctaggctcccgccaagaaccgacaaaccatgcgatgcgtgatatcgccgccgtgaagaaggaactagaagattggggacgaggcatcgtgcttctcttccctgacgagaagggctataagaacttcgatccgaaagagttcggcgatttaccgagcacgatcacatacggtctggatatcgacggggcgatccaaaaggagatggctacagcgatgaaattgcaaaacgccaataccttgccgatcttcttgatcgccgatacgttcaatcgtgtcgtatttgtctctcaaggctatacaattggcttgggcgagcagttaatgaaagtcatacataagctataacagatcgtttcacaagtgtgatctgatcttttcacccatgtgaaacgatcggatcacggctgtgaaacgttcttttcacataggtgaaaagatctatacgacaggagacactcatttcttctaccacaaaccgatcagacttcctccctagattcgttttaattcccttatttttcccgttcttcccaatcaaggattcatctctcaaaaaaataatatctttgattaaacctttttacgaaagggcagtctaaacttgcgtttggttatatattttggagtaacgagtgtaaattatcagtaaataccatacgagaacatgatgacaaagagagcgaaatggggagttacggcggctatcttattaatgatagcgggaatgatcgcttaccctcaattgaaaaacaagttcaaggcatcccaagatgccgcttccgtcgtacccacatcgggcacgagcctgcgaaaccagacacttaacatcaatgccgaggtattgaaataccaatcattaaccgataagatcatgagtaccggaagtacccttccggacgaagaggtggatttggctttcgagtcctccggtaaggtggtagccatctatttcacggaaggtagccacgtaaaggcgggcgatctgttggctaaaatcaatgacaagccgctgcaagcccagctaaagaagctggaagcccaagttcctttagccaaggatcgtgtctatcgccaacgtaccttgctggagaaagacgccgtcagccaagaagcctacgagcaagtagccaccgaatacgagaagctaatggcagatatcgagttggtcaaagcgaatatcgcccagacagagcttcgggctcctttcgacgggatcatcggacttcgctccgtgagtgagggcgcgtacgttacttcctcctcttccgtaatcgcgaagttgaccaagatatccccgttgaaaatcgagttttccattcccgagagctacgcggccgaggtacaagacggaaccccgatcctgttccgcatggagaaagacggtatgatgcagaactataaggcgaccgtttacgccgtggaaagcaaggtagatatggcgacccgtaccttgaaagtacgtgccacttacccgaatccgggcgagaatatcttacccggccgttatacctccgtcgagatcagcaagcgggagatcaaggacgctttagccatccccagcgaggccgttatccccgagatgggaaaagacatcgtttacttatataagaacggcgtggccgagcctcaagagatcacgatcggtatacgaaccgagagccgtgtacaggtattgcaagggttgaatgtgggcgatacgctgatcacgtccggcgtgatgcagttacgtaccggcatgaaagtttctattgataacttgactgaataaggagaagaacgatggcaaatatttcagaaaccagtataaaccggcccgtactctcgacagtgatgatgctggtcatcctcctgttcggctttatcggttaccggttccttggcgtccgggagttcccgagcgtagaccagccgattatctcggtcaacgtatcttatcccggagcgaacgccgacgtgatcatgaaccagatcaccgagccgttagaacagaatatcaacggtatcccgggtatccgttcattgagtagcgtgagtagccaaggcagcagccgtatcacggtagagtttgagttgtccgtggatatggagacggcggcgaacgatgtacgtgataaggtatctcgtgcccaacgctaccttccccgcgactgcgacccgcctacggtatcgaaagcggatgccgatgcctccccgatcatgcagatcgccatccgaagcaacaaacgctcgttgatggagttgagcgagatcgccgagctaacggtgaaagagcgcttgcagaccatcgagaacgtgagtggcgtggatatctggggacaaaaacggtattccatgcgtctatggctggacccaatcaagatggcgggttacggagtgaccccgatggacgtgaaaaacgccgtcgataacgagaacgtggagcttccttccggtagtatcgagggaaatacgatctccttatccatacgtaccttaggattgatgcataccgccaaggaattcaacgatttaattatcaaggaagacaacaacaacatcgtgcgcttcagcgatatcggacgtgcggaggtagctcccgaggacttgcggagcttactgaagaagaacggcgagccgatggttatgaccgttatcatcccccaaccgggagccaaccatatcgagatcgccgacgaagcctacaagcgtatcgagcaattacaaaaagacctgccggaagatgtcacgatcgagatgatgtatgacaacacccgctttatccgggcctctatcggcgaggtacaacagacgatctacgaggctttcctcttggtcgtattgattatcttcttgttcctccgtgactggcgggtcacgctggttcctgtcgtcgttatccccgtatcgttggtaggagctttcttcgtgatgtatatctccggattctccgtcaacgtattgacgatgttggcggtcgtgctctcggtcggtctggtggtagacgacgcgatcgtggtggcggagaatatatatgtacgtatcgagcaaggcatgtcaccgaaagaggcgggtatcgaaggatcgaaagagatcttcttcgccgtggtatctaccacgatcaccctgatctccgtattcttgccgatcgtgtttatggaaggtatgacggggcgcttattcaaggagttcagtatcgtgatcgccggttcggtcgctatctcctcgttcgtggcccttacgtttacaccgatgttggctaccaagctattgaagaggagagagaagaaaaactggttctatcggaagaccgagccgttcttcgagggattgaacacgatctacgccaagtcgttgaacgcattcttgaaccataagatatggtcgatccctatcgttatccttcttttcggatcgatcgggtacttctggaagaacattcgttccgagttatcgcctttggaggaccgttccatgatctccgtgaatatgcgcgggccggaaggggctaccttcgagtttatccgcgactacgcggaccgtatcgagcaaatagccgactccatcgctcccgagaagcaatccatcatgacccgctcgtgggaaggaggaggttcgctaaacctcatattaagcgatatcaaggaacgggaacgctcgcaaatggagatcgccgagaccttgtcgaaagaagtccgcaaagagaccttggcccgcgccttcgtacaacagcaatccaccttcggcggacgccggggcggtatgcctatccaatacgtattgcaggccccgaccttggataaactgcaagagttcctgcccacgtttatgcaaaaggtgaacgagagcccggtcttccagatggcggacgtgaacttgcgcttcaccaagccggaggcacgtatcgagatcgaccgggataaggcttccttattgggcgtcagcacccgcaacatcgcccagaccttgcaatatgcgttgagcggacagcgtatgggctacttctatatgaatggtaagcaataccagatattgggcgagatcaaccgccagcaacgaaatacccctgtcgatttaaaatcgatctatgtacgtagtaacaatggggaaatgatccagttggataacttggttaaggttacggaaaatgtggcgccgccccaattgtatcgctataaccgtttcgtatcggcgacggtttccagtggattgaataagggatatacgatcggcgatggtctggacgagatggaccgtatcgcctcggaggtgctggatggtagcttccgtaccgctctttccggcgagtcgaaagagttccgtgagagttcttccagtttgatgttcgccatgatcttggccttgttgatgatttatttggtgttggccgcccagttcgagagtttcaaggatccgttggtagtgatgttcaccgtacctttggctatcgccggtgcgctgatgttcatgagctattcgggtatcacgatgaatatattcagccagatcggtatcattatgttgattggtttggtggcgaagaacggtatcttgatcgtagagttcgccaatcagcggcaagagtcgggacttagtttgccggaagcgatccgctcgtccgcgacccagcgtctgcgcccgatcttgatgactagcgtatccaccatcctcggtttggtgccattggtatacgctacgggcgagggtgcccaagggcgtatcgccatgggtgtagcggtagtaggcggaatgttggtatcgaccttcttgaccctgtttatcgtaccggccatgtattcgtttatatccaccaaccgaaaaaagaacattactgaataataaataaacacatgaataagtacctatatacattactattggccttctcttccctctttatggcggaggcgcagcaactattcgatctgaaacggtgtatcgaaaccggattagagcagaactactccatccgtatcattcgtaacgagcaacagatcagcgacaataacgccacccccggaaacgccggttatctgcctaccgtagatatgagcggcggattcagcggaaatatcaataacaaccgtaacagcctgcaagacggatcgatcgagaaggcgaatggtataaacagcgagacgggtaacgtcggactaaacgttaactggacggttttcgacggtttcggtatccaagccgaatactctcgcttgaaagaattacagcgaatgggagaattgaacacccgcatgaccatcgaggatttcgtagccaacctttccagcgagtactacaacctgatccggcagaaaatccgtttgcgtaacctccgttccaccttggacctttccaaggagcgtctacggatcgtggaggaaaggtattatatcggctccatgtcccgtctggacttgcaacaggctcaagtggacttcaactcggatagctccaaggtattaaaccaattggaggtcgtgcatacctcccgtatccgcctgaacgagttaatggcattaaataatgtggaggaggaaatccagatcaaggactccttgatctacccgaacccgttcctcgacgaggtagatctatggaagaataccctcgaagccaacgcctcactcctgatcgcccaaaagaaccagacgttgtctgagcttgattataaaaaggtaaaaagccgctattatccctatgtcaagctaaacgcaggctacggctacacggcaaactggacggaagtgggcaattacgacctccaacaacggctggggcttaattacggcgtgaccatcggtatgagcctcttcgacggtttcaaccggaaacgtgagcaacgcaacgcccgcatccaaatcgagaaccagcaattgcgcatccaagaactggaacttgccctgcgtgcggacatgagcaacttctggatggcctataaaaacaacctcgacctatggagcctagagaaagagaacctcgtagccgcccaagagaactaccggatcgccatcgaccgctataaactcggcgagttgtctggtatcgaattgcgtgaggcgcaaaacagtctactggaagcggaggagcgtctttccgtggcggaatattccaccaagatctgtgagatctcgctgcttcagttaagcggacagatattaacctatatccgtcccgagccggagaaagccagtttctaggataaaggccagtgccacgcctatggcacaagttattataactccgtttaaagactagaggcttatgctaattgcgtttttttatgtaagttcgcggcaaatggcaaggtcatcattgcctaacgacaaaaggaaatgcaaatactaccaaaggttaatacattacgaaaaggatcgctcttgtaccgcggcatccgctaccgtaaaggattcggagtacattcgcctttcgtttttaacctcatcacgaaggtcatcgaggaaaaatgttcctattatagtttctatgatatagagcttttacgtaagcagttattattccgggaaggagagatcacctatccggaccggcagaacaaggggaaacgaaagacccgttccatcggcgagatcgtaaaacgggaatccatccggcccaagcatggcgccttattattccgtttgacaaactatttcaagtccaagaatatcctccagataggaaccacgatggggttgtctaccttatatctaacctcctatgccacgggattgagatgtatcgccttggaaaatgtaccggaattcgccacgatcgcccgtcaagcattcgctaaagagggacgtaatcccatcgatttgcgtatcggtaattataaggacttgcttccccaagccttaaatgacataaatagcttagattttgtttttttcaacactttatatgaacaacataacaacctctggctgtttaatgaatgtatgaaatacgcgcacaacgacacggtattcgtttttgagggaatcaaggcgagccgtaagatgcgtgaactttgggaagagatctgcgcatgtccggaagtgacggtcaccttagatctttactcgctagggattgtcttgttcaacaagaaattgcacaaacgagattatattgtttatttttaggattcaaaacaagtcagatatgaagaagagtattatctataccagaacaggcgataaaggaaccacttcactggtaggtggacaacgcgtgtcgaaagcgcacgatcggatcgagagctatggcaccgtagatgagctgaactcctttatcggattattaatcacggccttgaatgatgagaaagatactgatttcttatcattcatccagcataagctattcacgatcggttcttacctagccacggatcaagcgaccacggaattgaaaatcgagagcaaggtaacgcccgagagcatcgagcgtatcgagcgggagatagaccgtctggataacgagctgccgaaaatgcatgcgttcatcctaccgggaggatgccgctcggccgccctcgcacatgtttgccgcaccgtttgccgtcgtgccgagcgacaaatctatcgcttggccgagaattgccccgttgaggagcctgtattgatatttatgaaccgtttatcggattatttcttcgttctggcacgaaaagaatgcataaataataacggtaaagaaattatttgggattatacttgcgtataataaataaagtcatattttcgcggaaaaatagagaaccaaatcgcttcggcggttattaatacttgacagctatgtattggacattagagttagcttcaaaattggaagacgcaccctggcctgcgactaaggatgaacttattgactatgcacaacgttctggtgcgccattagaagtgattgagaatttgcaggaaatggaagatgaaggcgagatttacgaatgcatggaagacatctggccggattatccaagtaaagaagacttcttcttcaacgaggaagaatactagttcaattgagaattggaaattgaaaattaagaaatagaagaacgaggtggcggacgatcgagctcccctgcctcgttgtttttttgtgaaaatacaatttatccggatttgctgcgtttgtagttacaacgtgaagtgaatgtttaaatgagaagacgtcttctttcgatcttgatccttttgtgtacttgtgcgggaatcgtacgggcgcaatatgacgcacgcttaagtcaatacttcatggcgaaaccgtattataacccggccgtggccggagctacggaggacttgaatatattggctctcgcccgcttggaaatgatcggcgtacatggggcacccaagtcgttcttcattaccgcggatatgccactcgctttaggcaagacgaatcacggtgtcggattggttgtatttaccgaggcaatcgggcttttccagaatacgcatgtaggggcgcaatacgcctataagtataaattattcgggggagtcttgagcggaggattacaaatcggcttagtcaaccagtcgttcgacggaaccaaggtgataaaggttgagtccgagtaccatcaagagaccgacgcagccatccccgtagagcaggtcagcggcatggggttggatatgaacttcggtatttactatacccataaacggttttacgccgggtttggcatgacgcatatcacccaaccggagcttcaactggacgagaacgcctatacctatataggtcgttcacttaatttaatgggtggatacaatattcaattaaagaatccgttgatagaattacagccctcggtgttcttgctgacagacatgcaaagttttcatgcggatattaccgctaggctggaatataataagatgtttaatggtggtttttcctatcgggtgaatgaatcggtgggcatcatgttcggcgtaaagctaggtcgtttccatgcgggttacgcctttgatttcccgaccacggccctaggccgggcaagtagcggtagccacgagctatgtgtcaagtatgccttaaagctgaacaagacgaagacagggaaaaatagacataaaagtgtacgtatattatagtatatgaaaaaagtattattagtacttgtaacggtagccttgcttacctcctgcggtaaatctctccggagtgccggcggtgaggtgacaggtgtcagatcggtagcgttcaatgaacctgcgccgtatggaatggtcttggttaaaagaggttcgttcgagatgggtcccgccgacaaggattccttgtggggaatcatgccggagacgaaaggggtctctttcgacgcgttctggatggatcagacagaggtaacgaacgccaaatatcgccagttcgtttattatgtgagagactctattatccgtgaacgcttggcggacccggcttatggaggcaacgatctgttcaagatcacggaagaccgttacggggagcctgtcactccgcatttggactggaaccgtccgattccttggagacgggcgaacgaggatgagcaacgtgcgatagaaagtgtctattacacgaatcccgttaccggagagaaaggtttggaccctaaacaaatgatctataaatacgagtggtacgactataccgccgccgccctccgcaagaatcaattgaacccggcggaccgggttcgtaatacggatattcaggtagatccgaacgaggtagtcatgatctccaaggacaccgcttacatcgatgatgaaggacgtgtaatcaacgagacgatcacccgcccgttaagcagcgaatgggatttcttgaatacccgtatcgtcaatatctacccggacgagaattgctgggtgaacgatttcaagaatgcgtacaacgagccatatacccgtatgtatttctctcatccgggttacgatgattatcctgtagtcggtgtttcttgggaacaagcgactgccttctgcgtatggcgtacgaatttatacaaagaatccttgagcttgccaccgggacaattggtagagccattccgtcttccgtccgaaggagaatgggaatatgccgcccgtacaggtaagaacgagaataagttcccttggtctaccgacgagcttcaagacagcaaaggttgtttcttgggtaacttcaagccgggtaaaggtaattatacggaggatggccatttgattacgtctcgtgtaggctctttcgccccgaatgagttcgggctatacgatatggcaggaaacgtggcggaatggacctcaacgtcttactccgagtctggcccgagccaaatgagcgacatgaacccggatctgcgttacaacgccgccaagaacgatccctacgccatgaaaaagaaagtagtgcgaggaggttcttggaaagatgtctcacaatttatccgttcggacatgcgtactttcgagttccagaacgagagccgttcttacatcggtttccgttgcgcacgtacccaaataggattctctcgctccaagggaaagaaataagcgggaattataaatttaaagttttgaatcatttaagacaataatacgacgatgggaaaatatagaagatataaaaacagactggagatgttcctctccagcgaaagaggaaaacgagtattgaacttcctgtatagttggggtgcgtccatcgtaatcctcggtgcgttatttaagttattacatataccatacgctaaccaaatcctgttcgtggcgatgatcaccgagtctatcgtattctttatctcggcgttcgagcatccgaacaaggagtatcattgggaagatgttttccccgtattgaaatcaaagaacccgatggatcgtccggatttcaccggtacgccgatctcaaccatgatcaattctacggataatgtagaagacgatgagatagccgggggaataaatatcggttcggcagcgtctaaggcgaacgcgcaaagaggtggttccttgaatatcgcaggtaatctggacgtgacggaagaagataccaagaacttatccgagagcatcaagaaattaagcggagcggccgagcaaatttccaagatggcggaattgacggaagctacccaaaaatatctggagcaattatctggcatgtctgagaacatggagcgtttcagccaagtgactaattcgcttacgaacgtatccgatacactgttgaactcttataagagtatcacggataattccgatggcatcaaccaaaactcccgtggttacgtacaccagatggaacaattgaaccgtaatgtatccggattgaataccatctatgagatccagttgaagagtatcagttcgcagatcgaatctatcgaacacatcaatagtggcttgaatcgtatccgtgagatgtatgacggatcggtggtagatagttccgtattccgtaacgagacggaaaagatgactcgccaactggccgaattgaaccaagtatacagtcgtttattgcaagcgatgaccgtgaatatgggttatcagcagccacaacagcccagttaccaacagcaatatcagcaaccctatggttaccaacagcaacaacaggctccgtatacaaacaacccaatgaagtaaagaaatatggcaggaatatcaaataatcccaattctccccgtcagcggatgatcaacctgatgtatctggtgttcatcgccatgatggcactgaacgtgtcgtcggaggtgctggatggttttgagttggtggaaggtagcttgcgaacctctatcgataactcctcccgccgaaacaagattgtagcggacgagatggaagcttattaccaagagaatccccagaaagtgggtgagtgggcattgaaggcccgtgaggtgaaaagagcctcagatagcctctatacgtatatacaagatttaaagatccgtatcgctaaggtagctgatggcgagaatgccaacgtaaacagcatcgagcataaggatgatttggaagccgcctcccgtgtaatgctctctcctgtaagcggagaaggtaaaaagctgagagcggaaatcgataagtatcgtatctggatgggcggctttatcgaagattcggcgaagactgccgtattggaggcgaacctaagcacgactccccctcataaagcggggatcaatacccgtacttgggaagaggccttgttcgagaatatgccggtagcggcggctgttaccctgttaacaaaaatgcaaagtgacgttcgctacgccgaaggtgaggtcttatcgaacttattgaatagcgtagacgttggcgattaccgtgtgaaccagatcacggcgcaggtaatcccggaaagccagatcgtaatgcgaggaagccagtacaaggcgaatatcgtattatcggcggtagactctacgaaacgtcctacgatctatgtaaacggaaaagaattaccttacgagaataaaggagtcttcacggtgaataccggagctgccgggacattcccgatcaaaggttatatcgagatgccgaatagcgacggcagcatcatgcgccgggatttcgagagcgagtatttcgtgaccgagccgacagctaccgtggccccgacattgatgaacgtattatatgccggtatcgccaacccgatgcgtatcgccgtcccgggtgtaccgagcggtaatgtgacagctaccatgacgaacggcacattaacccgcagcaaggatggttgggaagcccgcccgtctaaagtagggacggaagccgtgatcacggtcaacgctcgcatggcggatggccggaacatagagatggcaaagactaccttccgcgtgcgtgccctccccgatcccctaccttatatcgagtataaggatcaaaacggtaacgtccgtaagttcaagggaggtatgatcgccaaacgtagtttggtagaggctgacggtattctggccgctatcgacgatgatttgctaaatgtaaaatatacggtattacgttttgagctgactttcttcgactccatgggtaacgctatcccggaagtggccgaaggaaccaacttctcgcaacgtcagaaaaactatatccgcaatttaagtaagggtaaacgtttttatatcacccgtgtagttgcgaaaggtccggacggtatcgaacgtaccataccgactatcgaagtaatcgtaaattaagattcgcagtatgaaacatctgtattacatagccgctttggccgccacttttttaacagcgatgcctcttcatgcgcaagaagaagttgagaacgaagctacgcagcaacaacaaacgcgtcgccgttcgcctcaagccagccgtggggaaagaaacgataagaaagataccggtttacccgaactgaccgtacgggcccaagatatgaacgagcgtttgacgcaagagatcgggaacgctcgctggatgcgtattatctaccggcaggtggacttgatgaaagagcagaacgctccgctttattacccgacccgcccgatgaacggacagatgaatcttttctccgtaatcttccagcttttaggtgagaacaagatcaaggcttatgagtatctggacggatacgaggaatttgacgaagcccatttgatcaacttcaaggatttgctggatcgcttctacatcctttatgaggagataccggggagagcgggtgaggaaccgactttcgtaatcaatgaaagcgatatacctgcagccgacgtgcggtcttactatgtaaaagaagcatggtatttcgaccagaataattccgcttttgatgtcaagatattggcgatttgcccgatccttacctctacaggtgatatgggagagacaaccatgcctatgttctggctgccttacgagaacatacgtccgtatatcagcaattcatacatcatgacgtctaatatgaataacgccatgacttttacgatggatgactatttccgtcgccggatgttcgagggggatatcatcaagacccaaaacttgatgaatctgccattgcaggcgtattgcccgacaccggattccttaaagaacgagcaagctcgtatcgaaggtcaattaaccagctttgagaaatcactctggtatcaaccggatacgactcaagtagcggtagacagcaaagccgcgaagaaagcagccaagagaagtgcccggaaagacaaaggctccaccaaggaggccgctccagagaaagctgctaaagtaaaagcgccgaaagcagagaaatctgcccctgtgcgcagtgtacgacgcagaagataaaaagaagcacatatgcctgtcatagagtagaatctatgatagctaagagagcctaatctatgataggaaagagaacctcgtctctgccttgccatagattaggctctcttacatatttctacttagaacctacccatgtccatttatgccaaataccttccaacggcccatgtttatgtctttctgcccaccatttacagaagcgtacttgcaagaagaaaaagacgataccgatgaacatactgaccgtataaccgcagtaaggagccaaattcaagccgatcgggaaatagatcaacgcaccgaaaaaggattgcgacacgtaattcgtcaaactcatcttcccatacgagcgcaagacggaagtgaaacgcctaaagccctcccattggtacagtaacacgaaagaggagaccaatacaaacgtgaaagcgaatttctgccacatatcaaggacgaccccggctgtctgacgcacgatagcgctatccgccgtatccatcaacaatactttcagttggtataaaggaccgaaagcaattgcggtaattatcaaagtctttatccaaaaacgggaattctcctccgaggagataaatagcttcctgcgcccgatcaacattcccagcataaacaacccgcaggtctgtacataccggccggcaccaacagcccagagcaaactagccttttgtcctaacgtcacgttctgccagatgaaattccataaatccccccgcttggtgtgctccgccatctctgagtacatctcccctactcctaaattgggtaattggtaatccggattaaacaggctagcgatataatgataccactccaccggctgcaataaaaagataatagccgttatcaagacagccttatcgctccatttacgcacgataaacaaaacaacgcccacgatcgcatacagcagcaaaacatcgcctgccggataaaaagcggcgttcaacgtagcgaagatcgtcaacagcagtaatctccaaaggaagcggtaaccgaagtcttttcccttcgcctgctggttcgaatactgtatataaaaggtaaaaccaaataacaaggcaaagatagaatacgatttcccggcaaacaaagcgaataccaccgtaaacacgccttcattcaatacgttcaaccatcccggcagcgtagccgggtccggatagaccggatagataaaatgttccacattatgcactaataagattgccaagacagcgaatccacgtagcgcatccaccacctctacacgaggtgacttagagattgttgtttgttgcatactatttatttgctatttgttgtttctgttaaccatgctaccttttgattggactcatgcggttggccgataatatccgcataaagttccggacgacgggcatttcggtaacgatatcctccagcctgtctcaatttctcagggatagccgtagcgatcacgaaatcatcacccagtttacggcattccgccacgatatcgccgaaaggatccagaatcatcgagcaaccgttcttgatctcattataatcacgcccgatcggattggagaataccacatataccgcattgtcgtacgccctagcgggaagccatttcataagccaagcacgtcccttcaggccatcgaactcctgtcgcaaggaagtcgggtcgtttgcccggttctcccataacataggatttatcaaaccagccccggggcgaggggaaggggtacacatcgtcacgtgaggcatgaaaatgatatccgcccctaataaggccgtggcacggacattctctatgatattattatcgtagcaaatcaatatgccacatttccatcccttgatctcaaaaaccacatattgatcgcccggcaagatattcggattaataaacggatgtagcttgcggtactttgccttcaagccattgccatccacgcaaacttgcgctttatagatgcgatccccatcccgctcaaagaatccggccagtagcgtgacgccaaactctttggcgatggcgatcaaggcttgcgtactctcccccgtggggatcggttcggcaatagccaacaattccttgcgagacaagtccttggcaaacgtatatccacaaaccgagcattcgtggaaagccactacatccgctccctctaccgacgctttccggcacatctcccggatgatagaaagattatacactttatcgttatcccgtgtctcgaactgcacggtggcgattttcaatggttccatgatattttgatttaattggtttatatatttttcgactagattcgcaaagataacaataatatactacttttgcgggataactttttctaccgatcatgaatatcagacaaacacgacaagaagatctggccgagataatggctatgtacgattatgcacgcaggttcatgcaagagcatggcaacggcaatcaatggatcaatggatatccttccgaggaattgatctccaacgagatcaaggccagccatagtttcgtatgcgaaaatgagcagggcgagttagtggggaccttttgttacatcgagggaatcgaccctacttacctaaagatctatgaaggcgaatggctgaacgatgagccttatgccgtgatccatcgcatggcctccaacggtaaacagaaggggatctccaccgaatgcttgaaatgggcgttcgctcattgcgataatatccgtatcgacacgcaccgggataatatcgtcatgcagaatttattgaaaaagcatgggttcaagcaatgcggtatcatttacatctctaatggcacggaacgcatcgctttccacaaaatagtaaatgcaacaaataaagaatcatgaaacatcctattgacctagaacattggaaccggaaagagcatttcctgtttttcggttccatggacgaccctttctttgggctgaccacccagatagacgtgacctccatctataaagaggcgaaagcggatcatgcctcttttttcctctattccttacataagattatgacagccgttaatgaggtggaagagttccggtaccggatcatcgacaacatccctgtctgcttcgaccgaatccacgtgggaacaacgattgggcgagaagacggaacattcggcttcggcttcttcgaatatacaccggacaggcaactgttccttcaaaacgcacagaaagagatcgaacgtgtgcaagctctcacaggcctttgcaaagatagggaatctgaccggcaagacctagtccgtttctccccggtcccatggatcgccttcacggagatgaaacacgcttcctctttccgtacaggcgattccgctacccgcatctccaccggaaagctgatcgagcagaacggacattggatgctccctatctccgtaacggctcatcatggcttgatggacggcagacatgtgtctatcctcttagatcgtatagcggataaaggttaaagacttagataacaaacaccctcgcccttagaagatcgaccatttgctttttaagggcagaggcattcaatggcttagaggcataagcatcgaatccgctattcatgacctgttcctcgtccgacgcaaaagcataggcggtaacggcaatgatgggaatgacttcggagagcttacggatttccttggtcgcctcatatccgttcatttccggcatattgatatccattaatacgatatgaggctcatattccttaaacagctccaccgcctcctttccgttccaagcgtgtacgattgtgtaatcattcttcagtatagtctcgaaaagcttgaaattgccggcgttatcttcagcgataagtaccgtcaacttatctttctcaacctttatcttctcaaaaatgacatcctccctcacaggtttctccggcgctttgtaggggaaggtaaaccaaaacgtactacccttcccgatctcagactcaacgcccatctctccccctagatgatcgacaatcattcggcagatagaaagtcccaaaccagttccttgggcgaaagaatccaacttcacgaatcggtcaaatatcgcttcttgttgttcaacggagatcccccggccggtatcagagacatagaagcgcagcatctttttatttaggcaagaataaccgtagcttatagagccttggtccgtaaatttaatggcgttagtcaaaaggttgatgataacttgcatcaaccgattcttagcgatagatacataacaatctttctccttacgctcaaacaccagacggacattttcatttacgacccttttactcatggaacgttccagatcggacaataaggtattgacatccacgtccgaatacacgaactccaaggtcccagcctctatcttagacaaatccaagatatcgtttatcaattggagtagcaacgcattattattctcaatgatctcggcatattcctgtttttcctccaacacgtctgtctcggcaaggatattggagaaacctacgatagcattcagcggcgtacgtatctcatggctcatattagccaagaaggccgatttaaggcgattggactcctccgccttgtttttcgcctccagtaattctcgctcaacctctttccggtcggaaatgatcaaggaagaaccaaccaacgtgagaggtttcccgttctcatcctttttctccacggcggcgcaagcttccacccactccagcccgtgcaatcctttattcggattatagatccggtattcctcctttatcttattcaccttaccgaggataagtgactcataagccttccttaccttttcgcggtcttccttatagatcttggagaaatactcggtatcgggaaccgtcagctggttctcgtcaaatagtccggagaaattcacgttcactgccttattcacgtcacaaagaatcgtatgctgaaccaagtcccacttccaaggagtgacattcgccacgtccaacgacatggacagtttctggttcacggtgcggagcacttgctgcgtcttcgctaattccgaaacatcaaccataaaaatatccacacaacccggggtattcgctgatatgatcaaaacattgaagtaacagtctgtcggcttgtagtaatattgtgtatttatttttttattttccgagaaaataagatgacaaatttttaaataccgcgacatttgcaacggatgaatttccgagccttttttccctatataagatttgtcacacttcaataaagcctccaatgccggatttagctctaaaataacataatcagtgggatactctttttcatcgaataggatacgttgtttcatatagcaaataggcatactattgaccaatctgctataatttcgcataaacattatctctttctcctgatacaatcgaatcctattcaatgaccggatcctcatgaacacaacaaaagcaataaataaaagaacaccgatccctgcgttaacataatcgccatattgttcccaaaacgtaggaggtctcatatagaatatcgtatccgcaggataacctgacgaaaacatccccctatttaccaagaccggatagtttaatactggatggggctgatacggagttataatggtattgaatacttcatttctcaaaagtccgttaatcgtgttaataagggtattggaaatattcgacgcagggaagaaaaatcctcccgccataccattctccacaatatccatatcattcaaggtaaagacaggcagatccgtatacgaactgatcatgcggtaggtatccgaacttaacacctctttattaccttgtgtatgtaacaatatccatgagtaatataatatgcctgtctgtttgtccgcattttgcagaatatctatcaattcatcagtctgtatatcaccggcagtgaccagttccaatttgacatccgggaaattattggttatggctttatgtatggaattctggttttgcgcactaatataccgcttatcagaaagaaataaaagtcgacgcatatccggattcgcttgcttcataagggaaactgtctccatgatatattccggcacataaataattgtcaattctctctcggtctcgacaatatccgataagttctgtcgttctggttcaggacaagcttttttggaaagataatattcccggggagctagatagtccttctctacgcaaaccaaataagataactccccaccccatttctcgttgagcctgtcttttaacaaagcgtatgagctattacctagcaaaatgattaatttaggggccttcttatatttgtccaataaatataaggtaaaatcttccacgtccttctcatttttcatcagcatcacatccatatgctccgtataggcatcaatatcctcattacccgctaccatacgttcatagatcggagtcgtaaaaatacggctccaaggcgtggattccgtataagaattaataataaggatatagtccgcctgtccgttatttgatagagccaagcactgggatgagataagtatcaacaaaattattagcaaaaagatagatttatggtaaccaccctttaatatcatgacctcttatttatttatactacaaatcaagaaaatgagtcaagctttatgcatattacccggctctaataaagatcgttcaaagatacataataaatattaactactacaggataaggcacataaattacgctactatccgtgaaatagcttttctatcgatcgatgaattaagctttcacttacatcgaaccggaataaccattcgatgttttccttatgaatcagatccattaaataaacattaattctttcccaacactttttagcgagaagtttttgttccgatcgaaacgttctatgaacaggacgaacgaacggatcattaaaaaattatcacgatggaaagagaaagagaacaaggttctgaccggcttgacacggaggaacgcaaagagttgaacgactctgatttcggattacccgaagaacggaaatatcctatgccggacgccacacacgtacgggcggctgaatcctattttcgatacgctaccgatcagcaaaagccagaattggctcgtaacatcttgagaaaagccaaagaattcggagttgatgtcgaaagtccgacaatcttagagtgggcaaaccgatactgacacccactttgatctcttattcaccaatataaccgtatgtgtttggtagcacatacggtcatagcaggttatttacgcacctgtaaaaagcgttttgtcaaatatctgcgaaccggctcgtcatagagtttcaaactaatgtaagccaacacgatactgccgacaactaatgccaccgcctccggccatgcttccgcgaatgtaaggttctccttcttcacccacccaaaatacaagtatataagtggataatgtaccatatacaaaggataagagatatctcccaagaatttacagatacgggcggaatgcttatcggttgttttcccggaagcccccagataaacaagcatagggaatattaggatcgcacatacggaatcatagataccgttcatccataaagcctcgccattaccgacatatggcatggagagtaaaacgacgatcgccaagctgcatatccaaaaagctcctttgacaggaatgggcttaaaaacgcgcgacattaataatccgatagagaaagaaaataacacacgcaagaaaccaccgatcagattgtattcttccatcgtccaccccacacccagatggcccgcaccggaaaaattgaatatagcgaacgaagccaatccgattcccgccaacacgacaagcgccgtaagcgccttcgttgacatccggcgaataaacaacgcatacataatattcccgatatactcaaagaacaaagaccaactaggcccattcaagggatacatctctccattcccgcggatctcaggcccggagccgggtacagccggtatcaaaaaaaggttgataagcaaagctagcatcaccatggatatggagacctgcgtaccatcccacttctcacacccttgtatacaaaacgcgataactcccaaaacagctccaaggacaaccatcggatgcaaacggatcaatcgacgtttgataaaatcctttgtcgtcatggttttccaccggtcgtcataggcataaccaatcacgaatcccgataggataaaaaagaaatcaacggctaaatacccgtgattaaatcgttggtcgataggactcgtcgcaaaggcttcgaatacatgataaaatataaccattagcgcggcgacacctctcaatccatcaagaaggtcataatgaggttttgtgtccgcaaatgcggccgctgagatttttgagtttgacattaattgtttgagcttatttttgatactactattactcctaatttccgcaaaaatacaaaaaggccccatctttcacgttattagacagttcttttttcattagttacacataaataaggtcgcaaaatacgaagtccccagcaaagcttacgcctgccggagacttgtttctttatccgtactccatcctcacggaggtacttacggacctcttaatttattactttagtattaatattaatccaactcccgcctgttcatccgtcacggattacttgggatcgaaaccctcacgggaattgtcgattatcttatttcattattcctttactttgaatattcaattatttaacgacaactttcacagtctcctcgccaaccgtaacgaatacgataccggcaggtacagcgattgtagcgttatcggatgtaagaacagtctcagctacagactggcctaatacagtacgtacataagcgttctgaccagcagcgccttggatcgttacgacaccgttgccacctactacaacgatagaggaagctgcatcttcaacagaaccgttagaagtcggaacgtcagtacctaaagtgaagaccatagcgatatcattgtcagcagtcaaaccaagttttccattcaaggcataaacataaactgtcttaccatcaatctttctttgagaagaaataacatactcatcctcagaatccttagctaaagttatattaaacttgaacgcatccagtctatcagaatttacagtctcaccatcagactccaattccttaacaacttttacagcctcaccatttacggtagtagcgattgtatcaacaccctcaaggatagccggacggaagattaccttagtatcctctgttccttccaaataatatgcctcatttgtatattcttgagcagagccttctacgaaatatttcaaagaatcctgagcattgaacatgaacattctctcagccggtgcttcttcgccttcagcaacctcaatgcctttagagatatagaatgaaggagtcttagccttgctatccgccgtatccaaccagaaaatcatgctttccgcagaaaggataccttcagtgataccattcttattcaactgatagttgatagaacctaacatattgtcaaatgatgcgtgacgtggttgagaggccaatgacgggttgaacggattagcgtccaagatctcaacgtttgcgtaaccatcattcaagtcactagctgctacataacgcttcttatcataagctacagttaaatttgtgctattaacgctcgcagttttaaccgcagaagtattatcaattgaagcagcataatcaagcgtaccctcagaagtcgcagctaacgaaaccaaagaataaccgcctgcggcattcttaatgatagcgaactctgtagcggcatccttttctttatcagtagcagcggcagcacctaaatatctagcatcgtcacccttaacttccgtcgtacgcaagatataagttggaacaaccaaagtatccttatccgcaactcttacaacctcattcttatcatttaagtaagcataagtattcgtattcaagatgtaatcagctacaccttgcaaagatttatccaaaatttcagcaccttttactctttccggataaagggtcaacattgtcgccttctcatcggtagagaccttcatactctttttatcattagaaagaactgcataaagagtcttgtcaccaaatacgttcttaccattgaatgtcatcttaaagccctcggcgatctgagtatccgtgaatactttataaccgtccgtacgagttgtagcgatcgtgttgaacttaacggaagttgtattcagtgctaaatcttctgttacacctttggaagctttttcatctcctttgattgttacttcttctccatcataagttgctttatctactttatagccaccttcttttccatccggttgtaaacgtaataccaaatcctcacctgtctcacggtttgtcaatgtaaaattatatttgccatcaaaaccagaaacgatccattgggataccggcatcgtaaaatccgcactattataagcaaccactcttaaaccgtcacctgtagcaggatcaaccgttaaatacttatggtactctgtttgagcgtttggcttaccctcagagctcttgtcctcatcattacttgtaaagtaaatatttaccacattctcagcgttcttcttcaataatacagaagcgtcaagataagaattcgcacccagttgcggatggataggagtatagttcgtttttgtacttcctgataatacagtagtcacataagtcttcgtatcagaaacagaaggcttaaccgcagctacatttacatcataagaattccaagtattaccttctttgacagaaggtttcatcgttaaaatcaacttaccatcctcattaaaggcatctttcaataagatcgtaaagcttgcgtttgcactagagtccttagcagcgacctcacctttcatccaatacaaagcgtaaccttcaccatcttgtttaccattgatgttgtaacgttgagtaggatctacagccaagaaagagatttcttttgcagctgatatggcagcttcattatttgtaccatcttcaacttcagcaacaaatgcttctaccttctttgcgtcacctttcacaaaataagtacctgtctggattttcgcatccgtagcagcaatctccgcactaacagttaccggagtcacggcatcaaacaagttaccaaccaattcgctagtcgtataatcgaaggacaaagttgtaccttttgaattgtattcagtcaaatacttatctccgatctcttcagcataagagaaggcctgtaaattactaccaacctcgctagcaggcaatgcagccgtaaacaagcctttaaatttcagcttaccatcttttacaataaacttcgtgttgaagtctgaaagatttttcgttgactgatctccggtaacggcagtaccatcgctctttgttataacttggtattccttaccatcaatagttacccacaactcgaaagtacgagaagagtagttacggatcgtaaattcggcggcagtttcatttgtagcagaagcagttgtagctgttaaagaaacaacttccttatcgcccttcaattttaagatatcactactcgtatactttgcatacaaagtagtatttgacgctcctaaatagaatgtcatgccattgcccaaagcggtctctgtagttgtataagaaacaacggtcttgtctccaacagcggcatacgcagcattaaaagcaggtccacctagcagtaaaccagctgttaacaaggtaaaaatccttttgttcataaattcaaaatttaatattaataatagtgttaattaaagtccatcccgtcgtttagcacccttgttttacccgaaaacgactagtctaaacgatcgtctagatcttgcgttttttaagggggtaaaaagaatggttcgtgaaaggaatcggcagtttcgtaacggatagcctatttgattgataagaaagaggataaggggtgaaaaaaatagctcagaagggttgcaagtatcgaagaaatgcgtacctttgcaaatgactaaaagaatcgatcgtttaaactagtcgtttatatcccataaaagattgtcaagcatcaaggtttttaactatatataatgtacaggcgtacattaaaataatgtaaacctatcaaagcataagatctgaatcaagcttcctctttgacacaaaagtactgatagtaccgctagcttcgggttataggtattttataggttcacccgataatcattgggggtatcttcaggctcatctatatttcagccggcagcctaagacaagtcgacctacagaaatatagaagtcggccaacagatgagatcatgggataaccattgccatataaatcgctgtcttatatcctgttaatcaacaggccaactcacttgagaaaggtttcccaagtgaataactaaccacttccagactcgtaagcttacggctacccccagccgtaagttattcacttgacaagccgtaagttattcacctgacaaggcataaattatacattaagcgtctctcccccgatggttatcgggaaatggcagaggaactatagatacaagtggcccatttgtctttttgacaacttgtaatctgaagtcccggagaaacgattattccgtacccaagtgcgtctcgcttccaaattcgagagaaaaaaacagcaattctctgtttgatagctatttgctaaaaaacggcctttcgttccagccgaaataattcaccctagttcatgttttacggtcgttaggcggtaataatgcccaacgctaccgtatgtgagggccgatgcctatatatgtgtaggcttacgccactatatgtgtagcttgacgcggctatatgcgtgggttgacactgctatatgtgtgagttgatacagccatatgtgtaggttgatacgtatatattcgttaaaaagcgacgcttatcgtgttaaaaagcggttgtggcagcttgttcgcgctccccgtttacgctcgttggcttttatagccagagagccgtgtcgtaaaaaagaaggtatttcaatcaaaaagataccattcatcgcattaagctgacatccgcaattctcgtcttatccctttgaattaagtctgtccccaataaatatcgggtgagcgtttacttgattaatattggtaatatatgaacgatgaatctacagaaaaatatcttgaggcaacgattcgtcagcaaccacgtcactggctcatagacaaaaaacgaaacggcagacatctccgccgtcccgcccaaaagagatagccttatctctgtttgtacacatgtcaaggttggttatttactgatatcagggcctatataaaccctgtttttcatatcgtgcgtaaacataagactttttttcgacaaaagagcagattccttcttctttttgggaatacatgttctaaacatgccacactacctcttggctactagcgtgagcttctattatagaggaactatgaaaaagcattttacatcaaaacataaagctaaatcctttcttctgcgaagcattgaaccgttcaatctccaaagaaagggatttctttaactgattagccataaatattaagaaagacctgcgtatgatgcaaattgctttcagtcggtttaaggattttctgaaagaacagtagccattatatgaatgtaacatcaagcccgaacttattactaaagatatgatggttctgtttgtagactatttgcaatcccgtagcgttggcgagggagcaaaaagtatctatcagcgtttcaagaaagtgatacgctatgccatcgaacacgatgtgatactgaaagacccgtgtaaagaagtaatttgcaaggtagacgaccaaatgttacggaaagatgtgctttcactggaagaaattcaggctcttatcaactgccattatgagaatgagaacccaatggtaagacgtgcctttatcttctgcctatattgtggtttacgcttctgtgatgtgaaagaccttacatataagaatgtagactactcaaacaagctattgaagtttgaacaaaacggtgaagaccgtgcagcctatggtgagcaactcttgaagaagctggaaaaacgactgaataccaaagggctgaatgaacgtcgattccgggagttcagacgtttgtatcttgtttatccacagttgaaagaagaggttttaggctatgttatgtcgggttcgggaattcggcggttgccgaccgccgaatttgaaacagagattcggcggtcagtaaccgccaaattgcaagtggtttcagaaatagcaaataatgactggaaattggctgcagaaaagctatttaacagattatcttctacgcatttgaatgcaatatctgctattgacaatcctattaaacgtgccttttatgaaatggaaacgattaggggatgctggactgtaaaagaactggaacggcagattgattcattgtactacgagcgtagtggattatctaaaaacaaagaagctctttctgcattagtacagcaacaggcagttcaactacagcctgcggatgtaataaatactcccttgaccttagagttcttagggttaaatgaacgggcattagttacagagaatgatttagagcaagccatccttgataatttacaaaagttccttctggaaatgggacacggcttctgctttgaagctcgccaaaaacgcatactgatagatgaagattacttctttgctgacctcgttttctatcaccgcatactgaaatgccatgtcatagtggatttaaaaattgacaaattccaccatgaatatgcatcccaactgaatatgtatctaaactacttcaaagcagaagtaatgcagcccgatgataatccaccaatcggtattttgctttgtactgaaaaaggagatactttagttcgttatgccacaacaggattagacccaaatatttttgtacaaaagtataaaatccagttgcccagtgaggaagaaatcaagagatttctttcaaaggagataggctaacaactttcaataaaaacaaaggtttagttcattttagatatacaagagaaatggactaaacttaatctgtaaccttttcattataaaacctcaaaaattccatttcacccacctgctttaaaaatttctgattttcaataaagtcttgcccatactttaaccaacgttttgtaaaacctttgaacttagtgcaaggaaatagatgacattggtagcagtgtgttattcctttctcaacgcaacacaggtaaaatgttctacatttttcacagcgggttttgttttcctctgctccctgacaatttttttcatctcgtgtgtagcttggacaaccgccacagaacacaccacaagcaggaatacgaccatgatatggttttattacagataaggtttttgccatccaaaaattagtcaaattcaatttatttgcctgtcgtttttgttccttcttcaccacgtatttttgcttctcaaagaatggacgagcagttagactcacttctgatgtgatttgtataataccttttgtaatagcatatcgttctatttcttccaaaagcatagttgcaatgcctttgccttgaaagtctgcgtgaatgaacatagagtacagatagccttgcggcgtaatggatgaaaaacctacaatctgagacagttgattaacagccacaataaaatagtgagtctttatcatttcctctatattggaaagatcatctccgcatgatgcccaatcttcaacttcatccggtgaataatcacgcctgtttactacaagcacggtattcttatataaatctctcagttcagcactatcagattgttgcgctattctgattttaaagtccattttcatctttggttttgtatcttttcgtataataccttattatcattaagggttaaaacatatatctgtttttccgaattatcgttaaatgcttcttcttcaaaacttccaaacttgtgaataatatcaaatccagcccgttccagatatgaatccaattcttgagggaaaaacatcctcatatccaaattctggattgaatgaaactcgccattgataaaatagtgccattctatgcgattgatttgggttgtactctcataacgcattgtttgttttatcaacacatcccgtccatcatccgttgtatattcggcaattactgcctgcactttttcgctctcgacaatatactggatgttgggattaaagcaatctaacagaaataagcctcctactttgagatgatttctaacgcatcctaacgcattgaataaatcttcgtttctgtataaatggtggattgaattaaatggaataaagattaggtcgaatttttcttgcaagtcgagcattctaatatctgcttctatgaaatcaatcactaattctgcttcgatagccttcatctttgcttgttcgagcattgagggtgtgtaatctactccgcaaatgctgtatccatctttggcaatggggatcgtaagtctgcctgtaccacagcacagttcaagtatttcagcctccttatttttcggtagccactttttgtagaattgcaaatcagatagaaaggtatttaatccatcatatatatttgcatcataaatcaactcaccaaccttgtaacctatattcatttatattctccaatattcattgtttcatgtttatataccaaacttatttctattctctttcgtgtccggatgggatagtgcgttaatgtcagccctactgatacattcattaaattgcaaggcaataatttaggggtctatcattatctcttctttgctatatttatcattattaccccattcggttttaagctgcgcataaattatatcatctacccaatccccacgcaaataatagctctccttaaagtgagcttcctttctgaaccccaatcgctctattaactggatagaagctgtatttctcggatcgactgaggctataatccgatgtttatcgagcgttccaaaaagataatcaactattgctttcaatgcttctgtagcataaccttttttctgataatctttatgtagtgtacatccaagttcagcctgcatattgttgtgattggtaaagctaattcccatatcaccaattaacctgttttcatctgcaagaataatggtaaactgaaaacatatattggcaatatccattgtcgccggcatattgctaatataatcacggacttcttcaactgaatcaggaaaccatccctgatacttatttttcgcaaagtcagaacggtaagaaaaaatgctttctgcatcttccggttcagcaagccgtatgattaatctttctgttttaatgggatatttcaccttgttgtttataaattcatgagttgagcaaagatacaaaaattgtctagccgtggatagtcctgccgaataattacatacaaaaaaagcttgactgattactcaatcaagcttttcaacttcagtacccagacccggtacaagccatagaaatcataggaaaataaaagaatttatctttcttattatcaatcacttgaatatttcctattttctctatttttgccatattttgcccattttccgttattcagtacacttttagtacactttgaaatatcattttcttttgtacctttgcaatatcggaaaacaaaagaaaatcaaccatttagcgtaatcacccggttatggtacctaaatcgggataaaacctctaaacaatggcaaagttagaaaataaaacgaaagaaaaccccaagttagagcaaaataagctctcggatggtagaatcagcctttacttagagtattatttaggtagagaggaaaagcccgtattagacgagaacggtaatcaagtgtactatgatagtggaaagatgcaaggtaagcccaagtttacagtaaagcacaacaggcgaaaagaaaaccttagcctgtatctgatagataaaccccgtacccctgcggaacgccagcagaacaaagaaacgttggagcttgccacaaagatacgtgcagagcgtgaacaggagtttaaagaaagcatgttgggctatcggttgaaaaaagatagaacggtcaatttcttagactatttccaagcctatatcaacagttataccaagaaagatattcgcatggtacaaattgcgcttagccgttttaaggacttcttaaaagagcaataccccatgaatgagtttaatatcaaaccggaacttatcaccaaagaaatgatggagcagtttgtagcctatctgcaatcccgaagtgtgggtgagggtgctaaaagcatttaccagcgtttcaagaaagttattcgatatgcgattgaccacgatgtaatgttgaaagacccatgcaaaagtgttacctgcaaagtggatagccaaatgcttcggaaagatgttctttctcccgaagaaatccaaaagttggcggcttgccattatgacaacgagaacccgaatgtcagacgggcttttatcttctgcttatactgcggtctgcgcttctgtgatgtaaaagaccttacctacaaaaatgtggattacgctaatcggttattgaagtttgagcaaagcaagacaaagggacattcagccagtagtggtgtggttattcccctgaatgatggtctattgtctatcattggtgaagctccggcagataaaaactgtttaatattcgatttgcctacttacgaaagctgctgtaagtcagtaaagcgttgggtaaagagagccggaatagacaaacatataagctggcattgtgcccgacattcgtttgccgtgaacattctgaataatggggcaaatatcaaaaccgtagccagccttttagggcatagcggattgaagcatacggagaagtacacccgtgcggtggataaattgaaagaggaagcaataaacagcttgcccgagctaaagttttaaccataaaagacttatctttgtaactatgaactttgaagcattagtgaaacatatcagcacgatacagaacacgttgcaggcacaagccgcacacgctgtaaaccttgcccttacttcccgtaactggcttatgggctgctatatcgtggaatttgagcagaacggagaagaccgtgccgcctacggtgaacaactgttgaagaagctggaacaacgactgaaaacaaaaggtctgaatgaacgtagattccgtgaatttaggcggttgtaccttgtttatccacagctaaaagaacctatcacacaatacattgcatcacaaattcaaattcggcagtcattgaccgccgaattcactgaaccaattcggcggttggtgaccgccgaatctgaaaatggtgtttggaaactatcaacagaatacccacaaaccgaaacatggatgattccagctgatagattattcaacagattatcttccacccatttaaacactatatcgggaattgagaacccggtaaaacgtgctttctatgaaatggaaaccattcgtggctgctggtctgtaaaggagttggagcgacaaatcgcatctttatattacgaacgcagcggactatccaaaaacaaagaagccctctccgctttagtccagcaacaagcaaccttattacaacctaaagatgttatcaatacccctgttactttggagttcttagggttgaatgaacgtgcattggtgacagaaactgatttggaacaagccattcttgacaacctgcaacacttcctgttagaaatgggacatggcttctgctttgaagcccggcaaaaacgcatcttgattgatgaagattatttctttgccgacctcgtattctatcaccgtattttaaaatgtcatgttattgtggagttgaagatagacaagttccaccatgagtatgcttcgcaactaaatatgtatctgaactatttcaaagcggaagtgatgcagccggatgataatccacctatcggtattctgctttgcactgaaaagggagatacattagtaaagtatgccacagccggattagacccaaatatctttgtacagaagtataggatagagcttccaacagaagaagaaataaaagagttcatttcttcctcaaactatgagagttacaaactttaaaattggcgaaaagaaaaaggttatttcttctttcgccagcatatactttcagtcaatagaaataggtttagttcgttttggatatatatacaaaagcacaaactaaactcacaataaagtggattaaaaaaagagaagatgttttgataaagtcaggaatctatttttgctttttgagagaacaactcacgaagttattctatatttcaattgtaattagtttatagtatgaaagattttaactcacaatatgccaaccattcgaaattagaacagctaaaacagttcattttggaacatggtacttatatcgaactcaaaaagggcgaacgattcactattcaaggcaaagtgaatcatcggggagcttatattgaacacggcttattgagatatactcgtgtggatgaaaaaggaaacatacacatagtaggatatactttctccggagaatttacgggaagtttatgtacacttatagaacctgagcaaccgtccttagttacaattgaagctgtttgcgatacaacgatttgttatatactctactcaaaggtggagcatttctttgccacaaatgctgaaaccatgcaaataaagtgtactcttgttgaacaatcatacttattaatgtatcatagattattggatatgtactgtaagactacagaagaattgtatcttgacttattgaacaaatgccccgatattcaagagtacataacactgaaggaaatcgcttcattcttaggagttactcctgagactgtcagtcgcatacggcgcaaattgaacaaatagcttacaataatgaaagaatttaactcatatctcaacaatttggactattcccttgtaaaagatttatttgcgagaaaagggatattgcgtacttaccataagaaagatttctttatccggcaaaatgaggtggaacgttttgctggatgggtaaaacatggcacatttcaatatacgcatattgacgaagaaggagaagagcacattgtgggatatgcttttaccgatgaatttgtatgtgactattcttcttttatgaaaagttgtctgtcagcagtgagcattcaagcgttaacagactgttttgtttatgaaatatcacgccatgatattatagaatgttgggaaacgaatatggaaactcaacgattaggaagatatgtagctgaaaatctatatgaaatggtgtatgaacgattgctcgattcgtattgtacacctgaaatacgatatcaaagactaatgaaacgttgtcctgaccttaaagatactgtacccttgaaaagtatagcttctttcttaggagttactcctgaaacagttagtcgcatacgccgcaaactggagaaatagccaatcttttaacatccattataccggggtcttgacaattgtcaagaccttttttctttattcttccgtattttgcattcatgatttaataacactgatatgatacgtaaattaacacaagaagaatataataatgcggctgatttgtcctatcaagtatatatggaatgtggcaggaatgatttcacccaagaaggtattgaaacctttaaaagtttcgtgtatgacacatcgttgatgaatacacttgacatatatggtgcttttgacaatcatttattgataggaataatcggtgtacatcaggaaaggcaacatatatccctcttctttgtcttgccacactatcatcggcaaggaatagggaaatcgctatttgactatatgatgagcaattgtaatttcacttatataacagttaattcttcaacctatgcagaaactttttatacatctttaggctttaaaaaagtgggtgaaaaagagattaataaaggtattgttagtatccctatgaagagaaatatataattattgtcaatcacttaaaatagagataagatgaaaaagaaaattactttatgtatggtgctttccacattcattatttgcgccatgttatgtctgacaaattgtagtaacgatgatgcccctacttctgtcttcacccccgaagccctgaagcaaactacttggcaagcgcaaatgaccgtgtacaatatcgaagatgagatagagtacacaaaacaatccattcttcagtttaccaacgaatcagaaggcatttatacaaggacgaacgaagaagacggatatatgtggaacacagattttacttatcaaataaatggaaaaatcatcacgttcgacaacatagcaggtccgtggacagtgctggaatacacaggaacacacctcgtaatggaagcctataatcccaataagatggtgtggacgttggagaaaacgtattaacctaaaaatagcggatatgaagatttcaacaattctctttttctgcctactaatgacagcttgtatgcagacaaaatcctttcaccggataaacggctggtactacgtaacatcacagactacagacagcctttcacaaacacctttccttactgttaaggatttcgatactttacgtttggaaactgaagcttttggacactcggtcattactggtgtcttcctccaagataaattgcctatatggagagaagccacagcaaagagtgtaggaaagtacatcgctttcgttttcaatgacacggtgataactgctcctcaggttaatagccccatagaaagcggatgtttccaaatttccaatccgcatggatatgatttggaacgtatctttagggaactacaaaaagaaattgatatatcaaggtttggaaattaaatgttaactggaaaatgggaacattaggttgcataaatgatatgctacaacgggacaaagagaaccgtgagcttcgcaagttgaatagagacaggatgaaagaacatcacaaatatcttgtaggcaaaggtaaaaatgctgatttatccaatgtttccattgaaaagatagaagaaatccgtaaaaaaaccatagaaaaggagcaatcagaccaaatatatatgtttaggatatatatatttcttacaatatgccttttagtgctatttttattgggattactttgctataaactatttttctaaattccccaaaaacaacaacttgcggattacaatattatgaattgaaataagccttttcctaagtcccgctaaggcttattttttatatgaatacatacatgaatcttattttagaacagcgatttttccgcttattgtcggaatattcacaacgtaaagtttctgcatcggagtttacagaagctattgaggaattggctacgcatgtagccgattttggtatcaacgaacaggattacagtattttacttcgctatttttcctttggtttacaccgtcttaaatcgtatcgtgtacggtttgagcaagaaaaaaatgccctatttgcatttaattgatgaagcgataggacttttgaacactgaaatacgccttattgaatggcgcatcaaatacccggaacaactacagcaacgcatcaataaacagcccctttcccctctccacctcgccgacaaaacaacccttatcaatatcatggaagtggtaagcggcttattcctctccaaagacatcgtttatcagaacggtaaacctgcctatttagtggacttatccaaaggttttgaatggttgtttaacattaagataagcgactgccaccaaaaacatgaggacgtgataaaacggaagccgggcaaactcaccgaatttcttaatggactggcaaacctaatcaaaaatgaacatgataagaaaggatatagataatcagcaacttatgatttatttataggggactccattagttctcctgtaatttctttgtatccgtttttagaactttgcttcatcaatcgattgacaaacaagaatgtataatctgaaacatgaagcaattatgtatatagacaatgacgaatttggtgaatggatgcagaagttgtatgccaaactggaagaactctgcaaagatgtacgggtactacgcaatgccgacagggtactgcccgaagatgacaacctgctggataatcaggacttgtgcctgttattcaaagtgagtatcaagaccctgcaacgctaccgggctatcggtgcgctgccttacttcactatcagcggaaaagtgtattacaaggcttccgatgttcgggaattcatcaaggaaaggtttagtattaccacgctacgccagttcgaaaaagaacactgtacgaagaaaaagaaatgaatctgaaaagccggaacggtagaatgtacttcatctgttccggctttccctgcttatggcttacccagcttatcggcttctttctttagctgttcggcttgctcgttcaacagccttgcacgttccagtgcttccgcctgcttttggatacgatattcaaaattcatcactgaatcggtcagacttcggataaaaccgttatcccgttgccacttgaacttgttttccaacatatcaaaagtttccccgtctgcctgtccctgcatcagcaaatagcggtatttcatatcgttgtcctgcaactgctgcatacgttcagccaaacggacattcaagaatatggaagcggaacagataaccagcactgccgaaaaaagaaacaatcctggacgaatccaagaagcgaccttgttgtaaatccgttgatagagcggtaagggcatagcttcctctttatccgtcttgcaagagcccaaagtatcaagcattaccttgaaacaacgataggtttccaatactattttcttggtgtcctcgatatgtttctgctgaccttgcatcctgttccttatctcgtcaagctggctttggatagcctgcaaatccttttcgggaacaaccgggttactgtgcaattccgacaatgcctgttcgattgcgttcagcctttcgagagtttcctcccgactggctggcgttacctgtgcttcctgcttctctttcagttcagtaaccattgagagaagcccctctaaaatcaaattttcctccatacgcttataactttagttgttttttcttttttttcttcttctttctcaaaaaggaatcatcgggcatttcatcagccggggctgacaaaccggaaaacagaccgcctaaacctgcaataaaagaattatctgctttgtcgggtgctgatactgatttctgaacaggtgcggtaaccgtctgcttattgcttccgactgtcgtctgccctacatccccaaaacatttatccagtttggagaaactgaaattacggtctatctccgaacccttgaacgtgtattcgcctttggaaaaggaaacgccttgtatctcgcccgtctgtcccttgtacttgaaccggatagtaatccccttttccgctaaccgctcctgtaactgctgccagtttcgggatttcccgatttcattctttacagcgttgtaaatctcgtatttcgatttgtccggctctttcaagcggtactgcttcacctgctcttttccaccagcaaaataaagcccgtgtttggttttcagtttcttgcacacctgttcattccggtacatatcgttcctgtccgaaatggtcttgccgttgttatctatgcgattgaacacgatatgtacatgtgggtgttcccggtcttgatggcgcacgatgatatactgcgtatcggtgattttcatttcacgcatatactcctgtgcaagctgtatcatcttctcgtctgtcaatttgggtgcatccactgccgaataacttagcgcaatatgtccgaccggctttttcaagtcgggattcatcccggtctgcatacagaagctgcggattatatcccccttgctttccgtcagaacgccgtccgcatggagcaaagccgcctgttccttgcccaacacatagtttacgcagcccttaaacccgcttcccttttttatttttccaatcatccgacaactggtttataatttcgacaatcctgtttttcagtttcaccagttccaccgccaccagtgcgaaacctccggcatttccccggtgcgccaactggttgatgttgttggcttcccctgccagtttgcggatggtgtccgcatcctgcctgttcagccggggtatgacctctgccgaaacaaccgcctgccggacatactcactgacacgcaacccggcttccccggctcgcttcctgatggcataatactgcaactcggtcaacttcgtactgactacccgttgctgcttctctatccgtttctttgccggacgtccccccggcttatcctttatattcgtcataggtttttacatttaaatggtatcttaaaaattgcgaccaacgggagaaattttctttgctgtcaagcaaagaaaggtagtttcggtaaaccgaaacataaccttgctctccaaattaaaccgcctgtcgttggtaatcctaccggactaaatacccctgccccttttcagtcttggggcggcacgttgtccggtttcctgctttatctcctgcgcttggctgatgctgttcttctgttcctgcttcctgccgcacaggtaatcgttcaagtccgaataccccctataattgtccgagaagtcacgcacacgataggagtattccaattcgatagcccgtgtcgcttcatatcctgccttgtcattgtcaagcatacagtggatgcgttcatacgggtacagcacgtcaatagctttcggcacattgacagtagagttgagtatgacataatcctgcctgtcaaggtcaggcatggtcgggcagttcttcatccggagcgtgaggaaagaaagatagtccataaaaccctcgaataccaaacacttctctctcggctctccctgctgccgtatatgggtgatgtctttcggggcgatgcagcccttaaaaaaggaattgcgaacctcgtaacctcctgccatgttcgggaaaccgatagcaaagaacggtctgccgttattggtaaaatggagttccttacattctctttttgccagttcgacattgataccccgtccctgcaagtaacggagcaatgccagatgggtaaggtcacggacttccaaatgttggaaactcggttctgccctacgctgaggaaaagaaaaactgaccgggcggacgtgcggtgtctgttccgctatccggtttaaaaggtatggcaggctgtcggagcaatagagttcctttgccagtgcaatgatgttgccgcccttgcctgcgccaaagtcataccaaaggttgcggtcagtgttcaccttgaaagacggttcgtgttcctcccttaacggtgatttgtaccataagccgttgccctgctgcttgacaggagagtagcctaaactgtgcagatagtctgcgatgggtatttgtttcacatcttcgatattcataacattttcttttttggggattaaaaaatagttgaaaagtgcgccagtcctgtttagtccgttatatatatacccgtaccatactaaacctgcttattccgatacagggaaatagtaagtccgttcctcttgtatatacacccggactaaaccaaactgacttttaataatggaaatcgggattatagcggtagcccttgccctctttcacaatcatgcgcttgtttacaaggaacttgttaagcgacacaagaacattgcgtccacgctcgtaaccgatactcgcataaccctgtttcaatgccgctatgacattggaatagccttgtaccacctgcttgccgaaaccgctctccaacgcttcccggtgttgctgttcagtcagttccgtaagcggaaagttcctgtcctgcttaggttgttggaatacataatcatccacgatttcgggtaaagcgctgtcattgatacggaatgcgaacgggtcaaattcccggtcacgtatgtgcatcgcctttacctcgcttatgttgccgtcctgctggcttttcgtgatttgcaggacggtttcagccttgttgttcagttccgtaccgatatgcccccttgtgttgtcatctcccttgttcaaatgcagtacggtatggatatgcaggttatatccgcttgaccagcgcatcaagaggttgattaggtcggttgattcgctggggctgttgatgtcgtacatcaagtcacggattccgtcaatgatgagcaaccccacatcgggcatattttcaagcatatagccgataatctgtttccgcttgtcgggggtctgctcccttagcacgatgaaaacaaaatcatccctgtccttgtcgataggtagtccggcaagccgcaaaatacgctccatgaccttgtggcaatggtatttgctctgttcggtatctacatagaggattttccgtttgttcggtggcaggtatgccgaatacttcagtacctcgtcatttttcaacgctgccgcaacgatagcggaaatgttgaatgtctttttgctcttggctttacccgtggatgcgctgaaattacctagcgtgccaatggtagagccgttcacccaaagtatttcgggcggtacttcgtaagtgtccgtcacctttagatgaatagttttccaaagggctgcgaaatcctctttctgcatggtgacgtcctgcccggcttctgtcgtttttctattttccataacctatttctttagaggacggttaaggatatacttctgcgcttcctgctctatctgcgcctgcgtcttgaccggattctgacgtaaccatgcttccaactccgctttctcaaaataaagcattttgccctgcggcttataatggggtatcaagttacccgaagtcagcttgtacaggtaacttttagaaaggttcaagaacttgctcgcttcatcgaagctaagcacgttctttgaaaggaacaacattttttcgagttcggaaactcttaactctaaatctctttccatattgtttaggaatttaggtgaaacaatatgaaggtgcgcaccctcgtttttttgttaacgggggcaaagttaagagcttgaaaatgaagtctaattgacctttgtttgagcgttcaatctatgctcaaccttttttcagttgtttgatgtatttgtctatgatttcatatcctttcggataaatgttttttgcttggtctgtcgcactcgacaggtcagtacgtgtaagcggttctccttttatcttcttcaatatcagtctattgtttgctatgacagactgccattcataaacaatataattatagcaactcaattgcatcataagataggctaacagacgggtattattaactttcaatactccattcagtttgcagttgaaaaaatcggtaagtattttggcactgacggtagtagtaaacatattcgcttcgttcacacattcagtcagaagtttgatttcattggctttcaacgtggacttgaaaggattgcttttgcccacaatcttggttggattagtatctgcactttcctctttctcttttggcaaggattgctcttgaatggtaaccacatctgtatagtaattactttcctgttcttgaagatggcgcaaatacttggaaagcacgacaagattaacgataatggacaaatagggaagccgcccatcataacaggacggttcatgcaaatatgcgtccatatcaaaatcagagcagcggaaaccgatatacttttttctttcatcagaattcaagtcctcaaaataaccgctttcccacaaaaaatcgggaatatccatatccaatacaatgttacgcacgacacagtatttttgttggatggctacaatattttcagtcacacggaaaatttcttgccgcaaataatcctttagctgggcttgcgtcaaatactcacgttttaaaaatagtgcatctactttagttttatagtcatgcgctatacaactatctaatatcttctgtatttctctgaaattggtttctatatgattttccataatcgtgtgcctttaaacgttcttactacaaatataaggtaagaatctcacttttcccgaaaacatcggcaataataaggaagaaaagacaggataagagttaagaaattataaagatacagggagaaaaattataaaagtacaccttttctttgtattcgtcattcagtacacatttagtacgccctataaaagcaaaaaaccctgataatcaggtaattatcagggtttattcgtacccagagccgggatcgaaccggcatggaagtgaatccactggtgtttgagaccagcgcgtctaccaattccgccatctgggcatttttgattaaccttttagctttagcagtaggtttgtttctcaaatgcgttgcaaaggtacagcttttttttaaacccgcaagcgtttgggtaaaaattttcaaatatttttttcacagtgggaatatgtatgggattgtttcgcatagaaagattatttcgttacatttgtaaacgtataatcataataacagccaatatcatgaaagataattattgcgtcatcatgggaggcgggatcggtagccgtttctggcctttcagtagagaaagttacccaaagcaattccttgatttttttggaagcggacggtctttactgcaaatgacatttgatcgcttcgcaaaaatcatccctactgaaaatatatacatcgttaccaacgaatcttatgcggacttaatcaaggagcagttgccggaattagcggaagaacaaatacttttggaaccggctcgtcgcaatacggctccttgtatcgcttatgcggcttatcatattaaggcatgcaatccggaagccaatattgtcgtagccccttccgaccatctgatcttaaaagaggatgttttcttgagggacgttcaaaaggcgttggatttcgtgaagagaaaccgtgcgttggtcactttgggcatcaagcctagccgcccggaaacaggatacggatatatccaaagcagtgatacggtagtagatgatttcaccaaggtgaagacctttactgaaaaaccggacctcgagttggcaaaggtatttatggaaagtggagaattcttctggaattctggcttgttcgtctggaacgtgaatacgatcttggaagcgttctctaaatatctcccggatatcagcagccgtttcgatctaggtaaggataaatttaatacctcggaagaaaaagcgttcatccaagagaatttcccttattgcctaaatatatccatcgactacggtatcatggagaaagcgcacaacgtatatatgctatgtgtagatttcggttgggctgacctcggtagctggggatctttgttcgacctagcgaataaagacgaaaatgagaacgcagtattgaaaaataacgaggcaatgctatacgaatgctccggcaatgtgatcgcattaaataacccgaaacgtctagccgttatccaagggctaaaagattgcatcgtggccgagtctggaaacgtattattgatttgtaagaaggatgacgaacaacgtatcaaacaattcgtagccgacgctaaaatcaaatacggaaaagaatacaactaattaagaattgagaattgagaattatcggcaagcggtattcattctcaattctcaattttcaacttcttagcaagatatcgtacaggataccacgcagctaaaaagcctatcgttaataccgtcacaaagactgttattatatcgaccgggactacacgtaccggataagcctctataataaacgctccggcagcttcccctagttttataaagccaaactcttgttgtagcaagcaaagcacaaccccgatcaagactccgatcaaagctccaaaaccggagatcatccagccttcaaacaagaaaatccgacggatcagactgtcatcagcccccatattacgcagtgtgctcacatcctcctgtttctcgatcatcaacatggataaagaacccaccacgttgaataaggcgatcgccaatataaaagtaaggatcaagaaggtcatccatttctcgacttgcatcatcttgaaagaagcctcttgttgctcaaaacggtcttgcacgatatattgatcacctaggatacgttgaatctctttctttaccggagcgatatccccgctatctttcaccttcaattccaccgctgtcacttctttatcataattaaataaagaacgggccaatgacaaaggcacgatcatatatgaatcatcgtaaacctgttggtccgtacgaaagacagcaccgatataagcatattccaaattgaaagaagaagccggattcgccatgttcaccttctcctcccgcttcggagcgtagatctctagcggagagacaaagcctgcgtttattcctagcgagaaagccaatccgatccccatattcgcataattcgccacctcgtcattcagaaggaactttccatcgatcaagatactatcgatctgcgccagtttctcatattgctcgtctacacctttcaaggtagctacaccctgacgatctcgataacggaccaaggcattgtcctgcaatacctcactaaaacaaacaatgccgggcaattccctcaccttacgtatctcttccgaggtcgggtcgaaaaccttccctttccggggcatgatcttcaactccggatcaaaattgctgaagagagaagataccaaatcgttgaaaccattatagaccgacaaggcgcatactaaggcgatcgtggcgacaacaaccccgcataccgataccatcgatatgatatttatggcattgtgcgacttcttcgaaaagagatatcgccgggctatatagaacggaagattcaaggctcctctgattacttatgcaaaagattgtcgatattctcgatataatccaatgaatcgtctataaagaagctcaattcaggaatcttacgaacctgcaaacgaatacgttgccccaaatcaaaacggatcgctttcgtattgctccgtatagcctccaatagctcttgcgatttatccgacgggaaaatgcttaaataagctctcgccacacttaaatcaggacttacacgaactacgctgacagagaccaatacgccatgcattccttgcgtctgcttctgaaatatatcactcaactccttctgaagaaggcgttcgatcttttgtaatctagtactttccatacgctttattatttactttttccagatcatcgtcaagccgtcacgtaaagggaggatcaccttctctacccgatcgtcttgcttaaccttttcattaaaaaccagtattcccttcgtttgtttatcggaaggatgcacttcttctaccactttaccgtcccaaagcgtattatccgcgagaatcaagccgcccggacggaccatcgggaataccaaatcataatactcggaatacaggcgtttgtcggcatcgataaaaaccatatcgaacgtctcatccaaacgggggataatctccatcgcatccccaaaatggacttttatcttgtccttatgtagcgagcgggaaagatatttcatgataaaatcctccatctcgtcattgatctcgatcgtatggatcaacgccccctcttccatgccttccgccatacacaaagtggcataagacgtataagtcccgatctccaagactcttctcggacgaatcatccggcaaaacatcttcaatatcctaccctgcaaatgcccggatagcatacgcggacggagaaggttcacattggcgtcgcgattcaacgccgacagcaaatccccttcttcatctatatgagaaagaatatacgcatcaatctcgcccgtaaacattcctcttactctttaaaagtaggcaactgatattgcgtgccggcatccagcacctttcctacgttgttaatctccaaaaagctggtaccgccaccttcgccgaagctaccgctcaaatacgctaccatatcgttgcgagtgatacgtccgctatggatcagctggttcaacgcatcatagaaatatcccctacggctgtcgttgtacggctgatgaaccgcccataccccataagaaagacccaacatacgcatcacacgaggattatagcatatagcgaacacagtagaggttccgcggaaagcggccagataacgtgccgtacgacccgtgtaactatccgtgataatcgccttcacatgtaatttagaagaagacttaacagcttgtttcgccaagaaagaagttacgtctaaatcattcccctcgatcggcacacggatatcattcgcggaaagcttggtcttctcggcttcacgagccactttcgtcatggtctgtaccgcctcgatcggatattttccataagccgtctcaccgcttaacatcaaagcatccgtacgataataaatagcgttggcgatatccgtaacctcggcacgagtaggacgaggattattaatcatggaatgaagcatttgcgtagccacgataaccggcttcttcacctccacgcatttacggatcagcatacgctggatacccgggatcttctcggccggaacctcgatacccaagtcaccacgagcgatcataacgccataagccacttccaaaatctcctcgatattgtctacaccctcttgattctcgatcttagcgataatcttgatagggctgttacgctcgtccaagatacgttggatatccaatacgtcctgtttgttgcgaacaaatgagtgagcgataaaatcgagatcatgatcgatcgcccaaaggatattattacggtctttctcagtcaacgaaggcaaattgatacgtacgcccggcacattcacgctcttgcggctacctagcgtagcgtcattctggatctcgcaaagcaaacaatcgccggatttcccggtaaccttcatttccagatcaccatcatcgataaggatgtcgctgccaatcgccaagtcgttcacgaaattcttataggacacacaaatacaatcatgcgaagtttcctgatcgggattaccgattaccttcacgatctctccagtcttgaaagggatcggttccttgtttaccgtcgtagtggtacgtacttccggcccctttgtatccatcaagataccgatacggtcggatacggtacggacgttatttaccacacgggtcaacccctcttccatcatgtgagccgtattcaggcgcaccacattcattcccgctttatataacgcctcaacgaacgcaacgtcgcagcgctggtcggaaactgtagcaacaatcttcgtatgctttaacatataccttaaattattataacctaattattaattctatttgataaccttctaaaccttctatcacataaacgattcgatcgccaaccgatacgaatccagcccaaacccaagaatcactcccctgcatgccgccgatatcatcgacacatgacgaaacgattcacgggcatgcacattcgagatatgcacctccacgactggcgtagtaaccgccttgatagcatcgtgcaacgcaatggaagtatgcgtataagcgccggcgttcaatacgataccgtcatattcaaaacccacctcatgtatcttgttaattatctctccttccacattactttgataataagatatctcacactgaggaaagcgggcacgtaactcgctcaaatagtcctcgaacgaggcatttccgtatactgtcggttctcgcttgcccaacagattcaaattagggccattgatgatctgaatcttcttcattcttattgtaagtttattacctttgtaccgcccgttgaggccggaattatccggcaaaggtaaggattttatttgacacattcataacgacataccgacaatgcgacaaggaaaagatataataaaccgatataacacctatttacggttagaaaaatcgctctcagccaactccatcgacgcctatttgacagatcttgacaaattgctacgtttcgcagaggatgagaaaaaggacgttaaggagatcagctacgacgacttgcaacagttcatcgcccaattacgtgacatcggtatccatccccgatcgcaagcacgcatcatctcgggtatcaaatcgttctatcgtttcttattgcttgacaattatataacaaatgatccgaccgaattgttagagtctcccaagatcggattgaagctgccggaagtattaaccgtcaacgagataaatagcattctcgacacgatagacctcacgcttcccgagggacagcggaaccgtgcgatgctggaggttttatatagttgcggactgcgcgtatcggagcttactggcctgcgttattcggatatatatcccaaggaaggtttcatccgggtagagggtaaaggaagcaaacaacggcttgttcctatctccgaagttgctttgcgggaaattaaaaactatctgtatgaccggaattcggtcgtggttaaaaaaggcttcgaggatattttatttctaagccggcgaggaacggccctctcccgtatcatggtatttcatatcattaagcaacagacagaggccgccggtatccataaaaacgtaagtccccataccttccgtcattctttcgccacccacttgctggaaggcggcgccaacttacgcgctatccaagagatgctggggcatgagaaaatcaccaccaccgagatatatacacatatcgaccgggaattccttcgcaaagagatactggaacatcatccgaggagtaggccaagaacttaaaagaaccgatcatgctccgctagcaaagccccaagaatgtcataaattatttatttcctcctctgacaaaccagtataacgcacgaccatttccatcgaaagcccatcagaccgcatacgccgagctgtttctagacgttcttccgcacggccttcttcccagccttcaaacttagcagtgctcaacacgtcattctggatcataattgcattcagatgttcgtcataagcataacgttcctcgggagacattgagtaatagcgtaatttctctcgtgcctcttccaagccgggggctgtcgtttcggaagttatgatcccgtctttcaagtatcgcacccattcctccaagggggtcacggccaccttatcaaactcattcacccgaaccaatatatactccggaaagatctccgaaggaagacgcttgacgatcgcacccctctccttggtatttacctgtaaatgatcatgggtatgcacgccgacaaattggttctacccgtgatacagataatcggttcctacgcctatatcaaaataaaggatactgatagaatagatctttttcaccccggaatagtcctgccccaaatgaagatgctcggtgacggccttcgccacgctatagagcacacgttccaaataataaagctcgcgggtattctggatctcgataaggatgatatctccctttgtgttcttagccttgatatccacccgattgaatttatcatcagcgtcctgctggttcccctcactctccaatatctcctcaatcttgatctgctcgcccaagaacacggtaagaaagccttctagcactccgaaattcgctttttgccggagtaggcgtttgatggcccagtcgaaacggatatatcgatcttgtaattccttcatatacttctcctctttttctgttttcttttccatagtcatatcatgttttagttaccccactattgggtggcttcaaatgtacataaaaagatccggaatacaagcttatcccatctaaaaagaaatgtccttccttttggatccgtaagtgaatagccaacgaacggaatcgtaagcggtcgcaaaagggtattcttgtgccgttataactctattttaacctcatattgtatcggtttaaactatttacccaaaaacaaaaaacatggatgtggacaaatataaagactactcaattcttagaaatgaggattctgcaccaaatggccatccgatgctctgtcgcaccaccttccgaatgctgatcgccgggagaggcgctattggtgaaatcaatccacgctttatgatcatcttccgcccataagttcaaggccgttccctttacctttttactatcataccgttccatagaggttcccagtaaaacggcgaaattatgtttatcgatcgaacgtttataactcaacgtattctcccaaagaagcttcacgccacgattcatcgtttgctccaccctcgatttctcagtcttgaccatataacacaaatagctaacagggaaccaatttctttcgccccaaaaagccatatccgtggagagagggctcttaaacgtaagactctcaaatacttctaattcaccccaaacagaacccacaaacttaatccctctacgggaacgctctatcaattcccggatattattcatctccggaagacgaattaaattaggttcaaaaatctgacgcttgaaaatgcggtagatactccacatagaaatgaatgtgactatctatcgggaatggcagttcttgaaataatggtttcataggctttatactaaaggtttcaacctctcgatcagttcatccccaagcgcccgtttattcacgatatgttcctgcacggcggtaacaaacggattattcatgaaatctcctcgaacaccctcgaaatcctgttgtttttctttgctggaaccatccacaccgaaaccaatcatagaagtcaaggagaattccttacgggcatcctcataaagcatctcatccaagcggatcacacattcttgccaacgacgaaccagatcaataatctctgcggcggaaatcgaacggagatccaccccataataacgttcgatcatctcgtacgcccatgtccattccaaggaataataacgtccgtgaaccaaacggaaaaagcattccacatcctctaaggaagcgatttccccctgttcgatatcttgcaacaaggcttctagcggttccctcgggaggatcaagcccgccaagtccaaccattctccggagcctttggattccgtagggcgcaattgctcccagacctcttccatagaacaataggtcgtaccttccaaacgcttgattaacgagttaccaaagaacttattaattgccatcccataaaagttcaacgcattccggagggaggaaccttttatacgagtattctgataataataaatctcggaagtctctccaaccaatgcctgcaggtttttcaagatatccaccgctttcagcatcttctggatcgtatagggactcaatagattatagttaatcatatccaagcgatccgggtccgtacgtttatcacgtttcggccatttctgggcatcacggatcgtacctacgctgcgaagattaattcccggaactaagtaagtctcatcatccttctctattaaataggagaatggaatatcggaagtatcgctatgatgatgatggcggcccattaccaaagagaaagcgccaatacgagccggccaaagaatatacgagtcgctggtagtcttggagccacgttccacgatcccttgatggatcggtcccagcttatacatatgattactctggttagagccacttcccgcgttcaagaacgaatacattcccgctatcaacaaactactcttatgcatagacaccgtaaacggaccggcgaatatagcgcaagcctccccattctcgaaagcgcagttgctgaacaacaaggaatcatgggccgagaagttatgcgtcacttggcaagcctgtccgataaagcaacggataatcttagcggcatccgcgatcttggctcccgaagagacaatgaaatcttgcgcgatcacactatccccgataaataccggggcctctctcttactatttacggaaccattttccagacgtgcgctattctctatggtcgcgtaatcaccaatcttcacgttacggatcgtaccggtattgacaatcttgaccttatcgccaaccgttccctccgtagaggcgataccctccgtataagcggtaatcatatcccgcaagcgttcgatcaaggccggacgatgacggtacaatgcgataatataagccaatgaagccgacaggccatcgtaaatcggaacctcacgcccgccggtctcattcaagaccgacacctcgacattattcccgaacgtagccttgccttccaccaacataacatttatattctggataaagcagtcatcaccgatctggtaattagcgatataattctgtacgttctcgatcagcacattatcccccaacgtacaattatgtagggtaacatgacgaagcccgctatgctttaccaatcctcccggtagggtaaacgctttacgaaaggctcctaacttaaccactcccgaaaaacgcacgtggttcacatattcaatatcaaacacctctggaacccaaacttgattccaatcatcggcccggcaagcctgagatcgcaaggtggcgatctcatccggccgcaaatttctcaaatgattcattggtactaattttgtaagactctactcttcatcatattgctgaaagaggaagtcattgtaggggaaacgggtgatatggatttgtttaacccgttcatacaacatctctttcaacgcctctatattcgtacgttccttggcggagataaagatgcaattatcttgcaattttcccatccacgtacgtttcagttcatccagatcgatattctcacgaccacgaggggtcaaatcatcttcctctttcgggacaaaggtaaatgcatccaccttattgaaaaccatgatcatcggtttctcggtcttatcgatctccgccaacgtacggttcacgacctctatttgctcttcaaaagtcgggtgtgagatatccacgatatgtaccagcaaatccgcctcccgtacctcatccaaggtagatttaaaagattccaccagctcggtcggtaacttgcggataaatccgaccgtatcggacagcaagaacggcaagttctcgataatgaccttgcgtacggtcgtatccaacgtagcgaacaacttattctcggcaaagacctcactcttgctcaataagttcatcaaggtagatttacctacgttcgtatatccgaccaacgctacacgtaccatcttaccccggtttttccgttgtacgcttttttgcttgtcaatatccaccagctctttcttcaatcgtgcgatcttatccaagataatacgtttatcagtctccaactgtgtctcacccggaccacgcatacctacgccgcctcgctgacgctccaagtgcgtccacagacgagtcaagcggggtaacatatatttatattgtgcaagctccacctgtgtcttcgcatgggcggtctgtgcacggctagcgaagatatccaagatcaagctcgtacgatccaagattttcacctgcaattctttctcaatattacggagttgcttcggactcagctcatcatcaaagatcaccaagccgatctcattctctaccacatactccttaatttcctgcaatttaccggtcccgacaaaagtgacggaattcgggtaatccattttctgggtaaaacgctttaccgcatccacccctgccgtatcggccaagaaagccaattcgtccagatattccttaaccttttgctcattttgctcgggggtaaccaaacccaccaaaacggccttttcggtctgtgcctcagatatgataaattctttcatgccacaaagatatattatttcaattatttacgtatatttgcgaacatatttacaaatataaatcaacttagctatgaaaaagagaatttggcatctatccagatgcgttgtcgtttgtacggcattcctattcgtacaacaatttatccagtcacaagtttcaaatccatctacatgggaaagttttgtgcaaagtaacgcaaatatatctatccgggatacgtttcggatgcagacatttgagggacttgcttctgataattgggattatgccattacaggtgaagcccttattgaagatatctccggcgtgaaagatattcctaacagccacggaaactacgggttacgaatgccaatgaatacgcaagtggctttcgagcatttcacgttaacaaatcatcaagatataaaaatcagtatacggaaagggggcatccttctagtagaaggagaaggcatgagagccagaacctatcgaaaaggggaaacaagttatccctccttagttccaaccataggagagagtggcatcaatcctttcaaaaccacagatataaaaaacaatcctccgggcttagatcttatcgtccccacaccggccgccaataccaaaaacggctattattatgtagacagcgtttacgcacacggcatgattcctacctattccctatttaccggaaacagcgattggaaccatgaggatcactggagccatctacccacctaccgtcaccgcaacgccttgattaacggtaatatctccataaatacaaatatcagctgtaaagatatctttattggcaatggaaatatccatattttaccaaccggaaatctatccgcaaataaccttactatctatccaaatgatggtaccttggcgtcttcctccaccttgcgatcgtccggaactattaacatctccggcaaaataacgatcgagaggaccttcgctcaaaaaggcaaatggtattttatctccttccccttcgatgtattcgcttccggcatagacccggatttccaactgggtgatgacaaaagcgatacaaacggtaactacttttacgtacaaacctataacggagaaaagcgagccaactcacaaagcccttccaacaactgggaagtcataccacaaacaataatcaatacatcccagcccatcttcaagaagaacaaggggtacctgatcgctattgacgcttccgccgatcgtcagaaccttcgtttctcctcgaaagcaaaagatatccctatagatttcggaaaaaacggtcaagcctctattccggtaagcattaacaaccaaagccagaaccagaatcacaacggctggtatctatgcggtaatcctctgccggctcctttatctcttagtcaaatagaatcaaactcagccttagacggatacatttatatatatgacggctccacctaccaaccctacgtgatcggtagcgatttcgccatccctccattctccgctttctttgtcaaagcgaataaaagtaccagcctatctgtatataatacatccgaaccagccaattataaattattatcaacgaatgcacccatatctttcccaacatcggaacctcaagcccgacaagatcctcctgtttccaatcaagccttttcatttccggaattaagctatcagctagagaacaaaactttattcattaataatcttccatcccccggtaaagtcaaactacttactccggcaggcatattggtatttacgcaagcggtacaggcagggaaccctatcctcccgattcccctcccacaaggtttatatatcttaattattcaaacagaacattatcgggcacagtacaaatgcgttttaacctcctaaagcccgaaacaatcttatatctttgccctgttttaagaataaaacgaatatgaagaagatcaacatcacaacaattgccttacttgtctacttaatcgtaatgagtatcatcggctggccgggaaacaattcggggaataattataccgaatatttcttgatgatcggcgctacgctcgtcatcatcatccttctacgctatctgcaagtcaaacgtctgagaatgcgagataagtggaataaagacgaagatcctgccaagcaataaaaacacagcctgtttttcttcacagaagaacaggctgaatgaactttattttattacactagtattaatattactgctttttcgccctcacaggctacttgaatgtctcgtaaagactacgcacagtataaattattcgattataaataagtacaatcttaacaggacacacacaccacttgtttcgcttactttcttaaaatgagttactttcataattcttacattttattcactagtactaaaacgtcattaaccaatacgcaaaagacaaccgacatcatttttgtaatcgtagcctaatcgtcatatcactgaaaggcaatacaatcgtgaacacatttttaataacatagacatatcatcgtaatataatcacacgtcctttgcgttctgaaaaaatagattaattctaatatattttaaggacaaaaggatggacaacagaaattactttacgatggcgattcccgctcttttgctaggcgtagcatacttacagccaatcaatgcggcaccagcggaggatctgccaaacgttactggacgaatgacgatcacccaacagacattcacggtaagtggcgtagtcaccgatacgaacggagaaccaattatcggggctaacgtgattgagaaagggactacaaatggagccgtaaccgattttgacggcaaattttctctctcgctgcaaaacaagcaaagcatattggtcgttacttatatcggttataacaccaaggagattccagccgggaatggttctcccctcacgatccaattgcaggatgacacccagaacctagacgaggttatcgtggtaggttatagtgtacagaagaaaaaagaccttaccggtgctgtttccgtactggaggtaggcgacctgaaagataccccggtatccagtgtagatcaaatgatgcaaggtaaattgtccggcgtaaacgtaatcccggataatatgcccggcggaggcgtagcggtacgtgtacgcggtttcagcacgatccgtaacaatgatccgctttatatcatcgatggcgtaccagtagagggcggcatcaattttctcaacccgaatgatatcgaaagtatgcaggtattgaaagatgcttcttccgcttccatctatggcgcacgtgcggcaaacggcgtggttatcatcagtacaaaaaaagggaaggaaggtactttccgggtaaacctagacgcttacgtgggagtacaaacctcggcaaaacagatgcgtatgctaaacgcccaagaatatggcgacttattatggcaggcacagcgtaacgacgggaaatcaccagtaagcgacgtgtatggctccggcgagaccgccgtaattccggaattccttgacgcagatcaccgtcttccctcgggagacgtggattgggttgacgagatcatgcaaaaagccatggtccagtcctataacctctctctggcgaaagcagataaagttagcagccacttgttctccctaggctatttcaaccaagacggtcttatgaaatatactggtttcgaacgtatatccggacgtttcaacaatgagtccaagctcttcaacgatcgtttgaaaatcggtgagaacgccacattatcacatgcgtggggaacctcggtcaccaataacgccgcactgggaggtatgttatacaacgcctataagaccgtatccattacccctgtttacgatctggacgggaatttcggcagcaacccgatcgccgacatctccaacccgttaggcgaattataccgtaataaggataataaagatcgtaccacccgtctattcggtaatctattcgccgaactgaatatcctagagggactttatttcaagaccaacttcggagcggattataaaaacctgtataaacgaagcttcaaggccaaatacaacgaattgaacacccagcaacccttgagtacgttgagcacgcaaaaccgttggaacttcaattgggtattcacgaacacgttaaactatttacggacattcgataaacatacgatcggagccttattaggtatcgagacaaaccgttatcaagaggaatacttctccgcctcccgtgaaggctttgcctcggatgacgataacttccatttcctcgatgcgggcgatagtggctcccagaagaacgcaggttctgcctttacttccaagatgatgtcttatttcggtaaaattgattataatttcgacaaccgctacttattcgcagccacgttccgacgtgacggatcttctaaacttggtaacaataaatggggtaatttcccggctgtctccgcaggctggcgtatcagtagcgaaccgttttatgatattccggctatcagcaacatgaaagtccgcataggttggggacaaaacggcaactctgatatcccggcttattccacgatcgattcttacatgagtaatccgaaccactccaactatccgatcgacggtagccaaagttccgtgacaaccggatacacccaaacccgttacggtaacgcaaacttgaaatgggagaccaccacgcaaactaatgtcgggctggatctaggcttcctagataacagcctaaccgttgtgctggattggtttaacaaagataccaaggacttattatgggagcgtcccttgatcggtaccgtggggggtacaaaccaaacggtatgggacaatgtcgggaaaatgcgtaaccggggtttcgaagctgaggtcagctacaataagagcatcaataaagatttcgggttcaatgtcgccttcaatatgtccgctatcaagaacaagatgacggaattagacggtgatgtctcctatatcggactgcctaccagtgtgattcactccctcaacttcgatcaagaggtttctcgttccgccatcggtcaaccaatcggctctttctacgcttataaagaagacggtttattccagagcgaggcggagatcaaatcatataccaataataaaggcgaactactccaacctaacgcaaaaccgggtgatatcaagttcgtagacgtaaacggagatggcgtaatagacggtaacgaccgtgactatatcggtaacccgctccccgatgtcacagcaggccttacattaggagtcaacttccataattttgacctcagtctattctttcagggaatgttcggaaacgatgtatacgacttgacccgttatgtgggtgatttctacaatcaatcgcaatacaacaaaaacagccgtgtcgttaatgcatggacaccaaccaacacgaatacggacataccccgtgtcaccatggacgatccgaacaataacatccggccctcgtcttactatgtgcaagacgcttctttcgttcgcttaaagaacatgaaaatcggttattccgtacctcagtccatcctatccaagattaagttcaatagcttgtatatctatgcgcaagcaaccaacttattcacgatcacaggatacgacggtatcgatccggaagtgggattgcaaagttactccagtgactaccgtaacctagatatgggtgtggaccgcggcatctatccgttatcccgcaccttcacctttggagtaaacgtaagtttttaatcatcaaacaacaacaaactagaatatgaagaaaatgattatagcggcctgtgccgtattcgcattgacatcatgcagcgattttctggaagagacacctgtaggcgaactgactcccgaacaagcacaagatcccaataacatcgagggattgattatctccgcctattccatcctagacggccagatggacgatgccagctccggcttgaattcaggatgctccaactggcaatttggcgatgtgatctcagacgatacctacaaaggcggaggtggtacgggagaccaaaacccggttcacttaatggaaatcttccatatcgacccgactatccaagattacaatcggaaatggctagccttatacgagggcgtgaaccgttgtaaccaagcgatccgtatcctcaaaggcagcgattatgataaaaaggagacccgtatcgccgagatgcgtttcctgcgtgcccatttctatttcaacttaaagatcatctataaccagatcccatatttcgacgagagtgtcagcgatccttccgcattcgcctctatctcgaataaggagtatacatccgatcaattatgggagaagatactgaatgattttaaggccgcctacgaaggtctcccggattcccagccggatgtggcacgtccatgtaagatgacggcccgggcttatatggctaaagtttacttgttccaaggcaaatggcaggaatgcgctacagcgacggatgaggtgatcaattccggcaaataccagctactccccgacttccggaatatcttcttgccagaaaatgacaactgctctgaaattttattttcagtccaagcctctatcaacgatggctccccgaacaactacaacggaaatccgggcgaccgtttgttacctccgggaggcccttatcccaactatggtttccttcgtccttcccaaaacctagtaaacgcttataagaccgactccaacggcttgcctttggaagacggcatagacgtttcggaaaatgattatgtagacacccgcctagaccacacggtagcccgccccggaatcatgttccttgatgtccaactctatgactggactcctcgtgaggctacggtttacggtccgtatagcccgaaaaaacgtattgtctccaagaactcaagttactatttggctatctggccatacgtaaacgcattgaatgtttatattattcgatatgcggacgtgttattgtggcgtgccgaagctgctatcgaactaggcgatttggctaccggattgaaatacatcaaccaagttcgcgagcgtgccatgaacagccagaccgtaaaaaccgctgacgggacagcggatgccgccaaataccggatcggattatatccgtcattttccgacaaagaggaggcgatccgagccttacgtaccgaacgacgtctggaattcgccttagaaggtgaacgtttctttgatctagtccgttggggaatcgcctcagacgtgatgaacacttatttcgagcatgagaagacattccgctctcatctccaaaatgcccgtttcatcaaagggacccacgaatacggcccgataccgcaagcggttatagaccttgcgaaaaatggaatcatcgagcaaaacccaggatattaatggaaatgctcccattcctcttaaaagaaatagctcctatccgaatattcgggcaggagctatttacatttgtctttttatatcgtctccttataacttatcccttaaaaaccttccggtataggatgcctcgcaagccgctatctcctccggtgtaccggcacaaaccaactgcccgccggcctttccgccttccggtcctaaatcgatcacataatccgcacatttgatcacatccatattatgctcgataattaccacggagtgacctttctcgatcaaggcattgaaagctttcaacaaagtcttgatatcatgaaaatgtaaaccggtcgtaggctcgtcgaaaacgaacaaggtaggttgctgcttctcttggcctaagtaataagccagtttcacacgttggttctcaccaccggataaagtggaggaagtctgtcccagcttgatatagcccaaacctacgtcttgcagcggtttcaagcgtttcacgatcttcttctcttgggagccggaacctttctcgaagaactcgatcgcttgattcacggtcatttccaacacatcgtatatgttagcgccttgatactctacatccaatacatcctgcttgaagcgtttgccgtggcaagcctcgcattccaaggtgatatccgccataaactgcatctctaccgtgatcttgccctcgcccttacattcctcacagcgacctccttctttattaaaggagaaataggcggcgttatatcccatctgtttcgctaggggctgctcgccgaatagtttacggatctcatcgtaagcgccgatatacgtcacagggttcgagcgagaactctttccgatcgagttctggtctacaaactcgatcgcctgaatcatattcaaatcaccactgataccggagcaatccacggtcaggcgggcggcatcatccaaatgacgtttcacgccctcgtagaagatatcacgaaccaaggagcttttacccgaaccgctcacaccggtaaccaccgtcatcacgttcaaaggaaacttcacgtccacaccctttaagttattcttccgagcccctgtcacttctatataattattccacggacgccgataaggcgggatctcgatctgatcctctcccgtcaaataacgtaccgtatggctatcggtacatttccggaggttattcacatcgccttgataaacgacctcgccccccaaacgccctgctttcggaccgatatcgatgatataatccgccgcacggataatctcctcatcatgctccaccacgaccacggtattccccaaggcttgcaactgtcgcaataccttgatcaacaaatccgtatcccgggaatgcagaccgatactcggctcatccaaaatatacaacgaacccaccaagctactacccaacgaggtagccaaattgatacgttggctctctcctccggataaagaggccgagaggcgatctaaagccagataacccaaccccacatccaacaggaattgcaagcgattattgatttccgtgagcaaacgtttagcgatcgccgcatccgtctcgtccagttccagttgatcaaagaaagcctttgcctccgaaaccggcatcgtcaccagctcggcgatattcttaccacccacttgcacatacagcgcttccggcctcaagcggctccccttacaaaccgggcaagtcgtctttccccgatagcgggcttgcatcaccctgtattgtatcttataaagattctcttccacgaacttaaaaaaatcgtcgatgccgtgtaaacctctcgccccatgccacaacaaatctttctctttctgtgtcaagtcgtaatacggacggtggatcggaaagttatatttctcgctcttcacgataaagtctttcagccattcccccatcacctcacctttccagcaaaccacggctccttggtagacagacaagcttttatcgggcaccaccagattctcatcgatgcccagcaccttaccgaatccctcacaggtcggacatgcgcccaacggattattaaagctaaacatcatatcggtaggctcctcgaatatcatgccatccgcctcgaacttcttcgagaattccttcacgactaccccttcctccgtataaatacgaatcaaacaggtaccatggccctcaaagaaagcggtctcggccgaatccgccaaacggcttttcaaggtcttatcgtccgataccgtcaggcggtccaccaacaactcgatcgggtaagacagcaactcctcgctcgccagtacctccgagatacgatataccgtatcatttaccgacagacgggcatatccttctttccgcaagatctccagctgctccttcatatcccggccttccggcaagacaaccggagcgaatacggcaaaacgagttccttcgggatatcgcatgacctccttgataatatcgctcacctgatgttttttcacctcggtgccggaaaccggcgatatcgtcttcccgacgcgagcatataacaagcgtaaatactcataaatctcggtagatgtaccgaccgtggaacgcggattacgggtattcaccttctgctcgatagcgatagcgggcggtattcccttaatatagtcgcattccggcttactcatcctccccaagaactggcgggcgtaagcggataaactctctacataccggcgctgtccctccgcataaagggtatcgaacgccaacgatgattttccactccccgacagcccggttatcaccaccagcttgtccctcggaatctctacatctatatttttcaagttgttgacacgtgcccccttgatgaaaatcgaattgctctcagacatattacctttatctttttctttaacgcaaagatagccaaaactaactgattctgccctatcttcatcgaactaattcacacagttagacaaggtgtgcctcgtctctactgccaagtaaataaaataacaagggcgaaatatttcatatttacagggaatcttctacatttgttgaaaatttcatagacaaacacagcaaggcacccatgtacattaaatattttcgcttcttagtagcgattctcttttgtgcgataacctcatgttctacggttcgcgagaagcctcgtccggctacgagtacgggcaaggaggccaagcgagagtttaggggagcatggatacagaccgcttttcaaggcgaatacaaggatatgactcccgcccggatgaaaaaagacttcatccgcaagcttaattacctgcaagcatgcggcatcaacgccatcatctttcaggtgcgccccgaggcggacgctttctataaatccgatatcgagccgtggagccgcttcttcaccggagagcaaggcgtagccccggcaggtgagttcgacccgatggccttcctgatccaagaatgccataaacggaacatggagtttcacgcttggttgaatccttaccgggcgagcacggcgggaaacacccgtttcgccgattcccacatctatcataagcatcccgaatggtttgtcacctataataaacaaatccttttcgacccgggattgccggaaagccgtcagtttatctgccgggtagtgcgtgatatcgtcggccgttacgacgtggacgctatccatatggacgattatttctatccctatcccgcagcgggtatgcctttcccggatgataacagcttccggaaatacggcttgcgaaaaggatacagcgaggcgcaaaggaacgattggcgccgggagaacgtgaataccctgatccgggaattgaaacgtaccatcctgctcaccaagccttgggtacgcttcggtatcagtcccttcggcatctaccgcaacaagaaaagcaccgcagacggatcgggtagcaataccaacggtctgcaaaactacgacgacctctacgccgatatcacctattgggtacagcaaggttggatcgattataacatcccccagatctattgggagatcggacacccggcagcagattacatcacgcttatcaaatggtgggacaaaaacgccaacggaggtcatttatatatcgggcaagacgtggcccgcaccatgaaagcggaccaattaacccgcaagatgcgttacgagcgtgccttgcctcacgtgagcggcaattgtttctggcccgccaatgagattctatggaacaacaagggcgtagccgacagcctgaaacggaactaccaccgttacccggcccttatcccggcctatacccatatgcataaccgtccgccaaaagacgtaagcaagctaaagaccgaatggacacctaaaggcttcttgttacattggcaagcggagcaaagccccacgaatccggagctagcctcctatttcgtggtctatcgctttaacgacaaggagccgatagacacgagcgatccctcgaagatcgtggctatcacccgggaaaccggctacttgatgccttacgagaaaggtaaggtaaaatatcgctatgtagtgaccgccgtagatcgctttcacaacgagagcgagggcaagacaaagaaagtaaaattataaagacaccaattatgttaaccgaccatcgctgcaccaaatataccgactgttcctcttgtagtttctaccagagggacatattcaagtatcgtctttatccgaaagggtacgtgatccctcagacaagatgcatgcagaacatggtctttttcctagtcaagggagagatctggctgaacagcgaggagcacccggacaccacgttccggggcggacagttcgtattgcaaccgatcggctcgaaagtggagtgcaaggtactcgactacaccgaatgtatcatctatctcttcgagcgtccgcaaaacatatgcgacaatcgtttcaacaaaggcatctccatcgtggagaacgaacgccagcagcccatcgtaatgacgatggtcccgccgatacaactcttcatcgagggcatgaagctttacctcaacgatgatttaagatgctccggactgatgcaagccaaacgctcggagatggtctacttgccgaactgctactaccccatcaaggagctagccgccttttacgccccgatttaccggtatagccacagtttccagtatttcgtgatgcagaactaccagaaggcgaaagacgtggagaccttcgcccaattgggaggctacagcgtacccaccttccgccgtatcttcaaggatacgtttggagagcccgcttatcaatggatgctgaaacgcaaatgccaagacattcataacgaccttatcatgacagagctttccatatccgagatttgctacaagtatggctttgaatcgctttctaacttctcgcacttctgcagggctaatttcggccaatctccccgctctgtccgttctctaaaggatgaaaatacataatattcaatgattttttttaaatctctcaacttttgcaactctttggacaaaaataacaattctcccctttagcattccctatacatttgcgtccagaagatcaatcataattgattttcaaagataaataaaatgtataggtacaataagacaagtattatcttaaagatctctatcgcagttttattcattatcggcatggtgctggaatgtagttgcgagagatccgaggaaccggagaaaagaggcacgggctacatcacttgcacccttcgttgggatagcgtggtagcaggttccccggtaccggagaaacttcgctattgtatctacccgtcggagggcgggccgatgatacagacggatgggaacgccaatggcatcaccctgttcttaccaccggataaatataatgtattggttttcaattacgacgcgaaaaacataggttttcgtaatatgtcgaagttcgaggaagcggaagcatatatctcctctctagaggatctggaggcatgtcaagacgaggtgatcccgttatatgtcgccacgatccgttcggtagaggttgagggggacacggagaagcataaggaattgaccttgtcgccgtttttcctatcgaaggacagttccttgaatctaagcaatgaaaggaaagggatcgcaaacaatatcaacgggctaaagaaaacgagtatccgatgagagagagccggttatttatcatcttgatctcgcttgtcatgggattggcgggatgctcgaaagagactatgatcggcgagtatgtagaccgttgcgcggtgcgcctcgacatagattggggtccttgcggtatcgacccggatggtatgaccgcgctcttttacccggtcgatggaggggagccaagccgtttccttaccaacacggtgacgggcgacgaggtgcgattgaggaaagggatctataacgtagtggtatttaaccaagcggccgaagaatacagttatctcacgatcgaaggtcaagatcaatacagcaccctgcggatcgtgatgaagacgacggatagcgattggtacacgcccaccgagggagagcggctgatctacgatccggaacctttagcggtagctacattggagggttttgaggtgacgcaagagatggtacgggcgaaccttaaggagggaaaggagttttccttggcttgccggcccgagaaggtaatcttcacgacccatctgtccttagagataaaaggattgcacaacatgcggactgcgaggggatcgattaaagggatggcggatacatattggatagcggatagaaagaccggaagtagcgtagcgacgcaactcgtggacttctcggaaaagacctttcacgagaactcaacgaccgatggtatcttatccggctcttacttgacactcggcagaccaaacgtcacatcgaaggccacggacgagatcagtaatttgcttacgctctccatcttattggtcgataacagaacggtcattacgaagcaatatgatatagctccacgtgccgcgatcaataatgagacgaaagaggtagaggtggtgctgggtacgaaaattgatctggataaggaagaagttcccgaggatattccgttggagctaccaaacgtggagccggaaaagaatggcggcgaagggggattcgatgcgacagtagacaattggggagatgagacgaatatcgtaatccccgcataactatagaatgataaatagtaacaacataaaacaacattaaaagactaaacattatgaagacaaatttatttatcgcagcattaagcctagtagtattggcgggctgctcaggcgaagatgagattggcacattggtagcaaagaatgacaatgcgattaatttcggaacttatgtggggaaacagacgaaggccagtattatggatgacaccaaactacaaacaacgggattcaatgttatagcaacttatacaggtgtcgatacatgggcatcattaagtggagacaaagctaaagctccaaacttcatgtacgatcaagccgttacatatactgatagtaaatggtcttattctcctatacaatattggccaaatgaacaaaatgaggatggagatcttggtaaagtaactttctttgcctacagccctaaaacaactagtatcactacaatatcagacaaagcaaaaacaggagcaccgactattaaactgactgtttccgatgaaattgatacgcaaatagatttagtagcagatatggtcacagatcttactaaaacaagcacaactatagatggagttgcagtagatgcaggtactgttaaattcaaaatggatcaccttctttctcaaattaagtttcaagcaaagctcaaggcacagtacactggagcaacaaagattaccgtaacaggatttaagttatcatttgcaaccaacaaaattaagaatgcaggaacatatacatttaacactaataacacagataatatatgggtgctggataatacttaccacaacgtagccatcgaaaaaacgaacttagcaaatgagttggacaataccgtagcactagcagcgaccgacttactagatcctatgtttttacttcctcaatcatatgcagaaaaagatataacagctgtgatcagttacactgtaaccacaagtgcaggtgatgttaataatgtaaagaaaatcgatttaccggtagttacagacggatggaagcctagtaaaaaatatttatatacttttgagatcgaattacagaatgtaacagttggagtagaatccgcagaatggggtaatggtgaaatcaagtaatatattatctttattttcatagattaagggattaggcttcctcaacatagaagacctaatcccttaattaatttttaatagccggtcttcatatcaccgcctctcttctctatcataaaatccattctcataaaaacacgccactctatatttagctaggattacttacaataaaataaatatcagaaaacctttcgatagcaatacggtcattatcccacctttttgagcaatataagccatatatcgtgacatccccttctcgcaagaaccacaaaacaatgagaaggagatagccattagtgccctttttctcctcgaaagccccccttttcacacacaataggtcgcgaaagccaacgcgaaaggccgcgttaggcgacacatatggttacgttgggcatcgtaagcagctaagaatagggttataacctaatgagaaaggcgttataaccttattataaccctatcgtaaccttatggaatagcccaaacacccggcaaaccatgagttacgatgaattaatttcgctagaataaaaggccattttccgacatctgtctgtctactaaacaattgctgtttttttcttgcgtatttggaagcgagacgtacatccgcccgaaataatcgactctcacggatttccgtttacattttgtcaaaatgtcaatccgcgaggaaacttctccccacatagcatacggatatcaattattcttcctatatttgcgataatccctcatatctaagcgtaggtcactgaaggaggacataagttaacgaagagcgtttaaagatattatcccgtattgaaatctggacaatttcatatccatggataatagacaataaacgctcacgtcggtgctatatttaccagtaattgctctggacgatataacagcatggcgtgggctattgtttattacatggatagggccgtccagagcctcaatacggtaatatcaatagtttccacgcttctgtatttttagcccggcaaccgatggagacaggttgcccttatccattaaatgaagacgatcctcctgttacccgtcttgtcgctatggctcctgcttgccacgcaagccaatgcccaagtctatcacctacatttatccgacaacacttgccggataacagaatgcgttgatactccacaaggcgtcaagcccttgggtcagacatggaaaggaaacaccttccatgatcgtttcacgctagatttcgatcgcgctatcttcacgtgggaaaaggaaggaaaagagacgtatgccaacaagatcatcaaccacactgccaaatacgctcaccactcattcaccacggagcagattaccgccaacctcaccatcaacagccatcgagccgtccttcaacttatccactttcagaatggccaatggatacaagtcacttatttttgcgagatagggaattaacggctcatgcgaacatctacaacatctaccacttatacttgatatttgtactttttatttgtgagtgaaaattccagccttaaaaaaggaggccttaaagtttacgataaacatcttcaaaaggtactctgcaacgttccccccaaatgcctttatttccatcccgtatcccacaaggaatagccatgtttatttcagcaccatgaggtagtttcaatgtcctttttagccgacggctgtccagcccttctaaggggcacgtgtcatagccttcgtttgccatcgcaatcataaacgtttgtgcggcaagcgcacaggatttatgggctgtcacacgtatgtcattctcggaaacttcaagcatcataggacggaaaatactgattatattagccaacaatttcctaagcaatccgagaataccgaagaaccgggcataaacaaagggcatcaatataccgtaatatatttcccgatccttaatacgtttggcctgacgttctttaggactgtaatgacgaatgttctcccgttcaaaattgagtacgaatcgcgcatgtttcttgtaccagtcacgccgaaccacaaaaatgacaatttgtgaagcggtagaagccgctttctgaccaaggcagtcccttgaaatttttgccaataattcaggttctgtaatatggtaaaattcccataattgcatatcagaactgttaggagccaatgtagccagttccaaacaatgttttaccttttccgtatctattggtttttctttatcatacacccgtacagaacgacgatgatgaaggacttcatctaaattcataatgatactgatttgaattaaacatttattcccagctgattacttcagccatttattatcgtgctttatttaattgccgcataacgaccttcgccatttctttagaactgaacgggtcctgcccagtaatcagattattatctacaactacttttgaagtcataggtatcaatgctttttcataatccgctcctctctctttcaacaacgcttcaagatcaaaaggcacgtcttcttttcttctggcaagactttcctcaaaccaactgaatcccgtcagctttttgcctttaatcatatattcgccattggatagtttggcattcaacaacccactgaccccgtggcagatggccgacactatcctcccactttcatcctgtttccttacgatagtctttaaagcttcattgccaggaaagtcatacatcgcaccgtgtccgccggctaaatagacacaatcaaactgttgttccaacaggttatccaaactgtttgcatgatccaacagctttttgaattctggcttttcccaatacttttcggacatttcatctaaaaaaattggttttaaactttcgggatcaatgggagtataacctcctttcggattggctaccgttatgtcatagccgctttcttttgcactatgatagatatgagtaaactcactaagccataatccggttgcgagtttcccattggcaaaagtccctgtgctagtaactattattaaaatcttcatgataatcaaattattgattcatattctttaaaagaaaacatacacatggatagattgtttttcagaatatggaatctttaacataatccgaaaatatgaaaacctgcaaatcctttcaaatgctatctctatccaccagcattcgataaggagaaattaccgatccctttcctattacctccgggaggaagcaatttgatgaatattgtttccatgatgcccaagttgaaagaagaattaagaactattttcaacgactatggcttgaaatatgtcttcgataccaatagccaggagattaaagtaatgaaagaaaagaaaccgggagagatatttttaattccatttcattccatagccgataccctgcagcgtatgattttctacaaagcggctattgaaagtaacagtgagtccgcattagtttttgaagaaccggaagcccactcataccctcctttcatatcaaaggtaacgcaggatattatccaatcggacagaaaccagttttttataacgacacacagtccttatgtggttaacgactttctggaattaccgagtgacgaacttgccatttacctagttgacttcaggaatggggaaactttcgtgaaaagagccagtgacacagaagtacaagaaatgtacgaatatggcatcgagctatttttcaacaccgaaacatagcgaaagatacagaacacattgcaggcacaagcccatacccaagtctaccgcctacgcttattcgacagtacttgcaggataacggaatgcgttaaaaactattttacggaatgtccaaatgttctgtcaatacgtttacgaatgttcgtaatggcgcaccttcataattatccaactccccaaccaagatcaacgcggcgttcttcatccatggctggtatgggatagatagttcataggggatttcacggatcagttccggggtgttcttgattaccgtataagcgtcgccatcggcggctttcttgccttcgaaaactaaggtacggtcgaacattttttgcttgtttaccccgtttagtactaccggggccatgactacggaatctctgtcgctactcaacatcggcatcaaggacagggtttgatatcgtcccacggagagtccgcagacactgatcgttaggtctagacgcaaggagttgccctcccgctcgatgcggttttgcttcacggagacttgcccccggtaagattgtataggcacctgcgctcctgccggaagaacaaggccgatcacaagcaagcatatatacaagcatatataaatgaatgtcttcatagatttatctctttatttgatgatgtaaacgatactgatacctgcctttgttaatccccaatactcgttgcggaacttgccgataggcgcatctcctctaggaaaagcgtacttatcatattcgaaatgcaagtatccgaaacccgccgtgaactccacgttccaacggggcgacacgtataactgataaccataagagataccgccgccataagcgttaccgttataactattctttttctccatcccatacaggagcttcaaaccagcgaaatcgtaatccatatactgggcatgaaccccgaagaaatgtccgttgaaacgctcgtgtatccagtaacgcgcctcgggctgtatcatccaatgcttaaatgacttatcgctcgagaatgtccaaccgttataataccccgatgcctcaacggaccaatgcttgttgaaagcgacctccgcccctatgttcggcgtagtgatcgcgtcataaagcacattggtcttcacggccacgacctgtccttgaatatctataaaagttggcaaaagaaatactaacagtaaatatagtttattcatatctcccggttcattaggtttgtttatttaagagacaaaaccgtacaaatatagataatatttatcagttcattcgtacgttaacttatataatatccacgatttacaaacggaaaacgttatctttgcaagataaatccagaatatgactcatgaaggctaaatatatcgtgatttttctcctgtcactcctttcgtttgtcgcttgcgataaagaggaggtcgttatccctactaccgcccctcgtacggttcttatctatttcgcaggagataatagcttgagtggatacgtgagccaaaacctgagggcgataaagaaagggattgagcgagatggattgaacaacggcaatttattgatctatacggataagcagaacgaggctccccagcttttccaattaaaagtggaagcggataccatccggcagatcgtgctcgagacctacgactcgaaccagaactcggcctctaccgagacgctgacgcaaataatcgacaaggtacaaaaggaatatccggcggatagttacgggttggtgctgtggagtcacggaacgggatggctaccttcggatatctatagctatctgcgttctttcgggcaagacgggaagaataatttcatggagatcaatgatttggcctccgctttatcgaagtatcattttgattttattttgttcgacgcttgttatatgtcgtgcgccgaggtagcttacgctttccggggatgtgcggattatattatcggctcgcccacggagatactggccaatggtttcccctatcaaacgatcatgggggatatgttcaaaaaagaagctgatgtggtggggatagcgacaaagttttatacgtattatcaaagtgaggcaggaacgatctcggtcatgaaaagcgatgagttggatgaattggccgctacttgccgtaccctattccatgataagacggaaagtgatcttttcgccgtacccgttagcgaattgcagatcatggagtatttgacgccgaattatcatgccttatatgattttgatgattacgtgagccgtctggccacggaagagcaatataacgcattcaagcggagcatggaaaaggcggttatttacaaggctactacacccaaggcagtttacgcttatccgtatccgtatggaagctatctgccggtcaataaatatagcggcttatctatctacgtcccccaagaagccttgcccaaactgaacgagtggtacaaggatcttgagtggtataaagcggtctattaatcaccccttatccaacgctttccgcgaggagtgtgaagaaatagtaagatactccctgctattgcagcaacaattgtaaaaaacacagccactactatcatactaatctattttaagtattaaacttccaatatatgcgaaccatacggtagcaactaagccaactccaaaaatataccaaatgatcaaaggtatagtatcaacatatgataacctttccctattacctatattaaagaaagctccacctaatcccaacactaaagccgcaaatgtcaactttgacaggtcaaagaaatactttgcgatattctccttccgtatcttcactaactctcgcgcctctttattcttttctctccttctttcaaaatcactcatgacaaaaatagtatttatatttcacatcccattctatttcactaggaaaacttctttataacgttcaatttttccttgaggatgaacaagttccgcatagaaaatataaacgcctgttctcaccttggaaccattcaccgcaaggccgttccaagtcaattcaccttctatccctaataagtcatgatttaccacctcactgatacaccttccggagatatcaaatatccaagctctacaggtatagccggattcatctagatggtaagagatggtatattctttcgtcgcttcaaagtaaacgggaggctctatgcccgttacctcgccttcatcttgctttccatattgggaattccgatagccgggcgtaccgtatcccgccgtggccgaagccgaggtccaattcatctcatcctgcgtatcgctatcaggattaatccgctccaaggcaatccccttctcgtttttcacggatggggcatgccatttagaggaataacgaatctcatcgatcataacctcatcttctgtacgaaacaggactaacgtagcggaggtatttgccaagaccggaagttttaattcatgcaaagcatccggcgaagatatcagataaaaatcgctcactcctcccatacttttagtcagcaacgcataatcttgtggttctaccggagagactatagaagataaaggataatgcgaactcaatgtaccatcggatttacgagtagcaacagacagtccggccaaaggcaatgtccggtccgaacgattataaagctcgatatactcactcccttccgggtaaggattcggcaacaactcattaaaaacgatctcattgggtaagactataatgtccgtggggatacccggtttatggggagcgtccggacgatctggatcttctggttcatcgtcaggagaagagttcgcggaacccggcgtgcctcctcgctcatccgttgataaatgaaagccggtttcagaacgttcccaagcgataccggctttcgctttctcataggcaatccggtcgatctccttaccggaaggatcgaataaagcaagctccttccccgtgtttaccaacgacgccgggaatttatccaagggcagatccagccccgcatcatcaatatgtatatccctaccggaccgataaagcacgacatatccatccgcatccaaaaacaaagctgtcaataccgttggcttactaccatataagaatgaccaaccatttaactctatagccttatccgtcgtattataaagttccacatactccgtttccggaaaagccttttgtcctttcggatcagccatcacctcattaatacggatactaccagcggggaaagaaggagtatccggcacttccggttcctccggaacgtcgggctcttcttcatattctaaccgaatctcggtagaactctccggaatcttatttccctcaagatccattaaccccgagcacaacaaatcataacccatgccaaccttcaactctttatcaaagctgatattcacatagatccgcatatcatccgcataggtcatacgagaagcattaccgatacccgatatagagaatatcgcctcacggatatccaccggaagattatattgtaattggaaaacagactcggtgatcggttggatagcaagaagccgcggaagaaccaacggctcatcgggctcattgggttcttctggctcttcgggagtatccggcttctctggttcgatcgagatattatcggatataatgatgtagttacacgcaaaatcatttactcgagttttagaatagcggcattcaaaacgtagttgtccccctttacatgaagaagaaacttcagactcacaactccctatcaagacaaacctacccttctctagcacatataagttccatatcttatgattttctaaagtaagtttcactttcaaatccacggctcccaacaagacatcgagcgctttctctattaagatctttggattcttctccgttgcggtatgtttccgaaaagttatcgttttcttattactgccgatttggacataataatcgttttttaatccaagcatcctctgatcatctaaataaacatgtagccggatatggttttgatcgcttggtttgaaatccatccgaatctcaaattcccattccattgtagcggaataaacgagaggagtttctatggaaacacttttccgggtaggatccgcacgtgagaccagccatccggtctcaatcacaaagcaatctaaatcacccgtccaagggttatccgatgtaatctccagtccattaaacggttcttttaactggggataagcgcaaagcggaagtaaaaacgcaagaattaataataattgtttcatagctatatcgttttagttataaatttctctatctttgcaccctaataagttacaactgtaaataatagggcgcaaaaggcaaaaatatgaaagccctttacagacagcaaagttataactattttacattattcaaattaaatcagtgctcaaaatgaaagtagcaattgttggtgtaagtggagccgtgggacaggagttcctgcgtgtactcgaccagagaaacttcccgatagatgagctggaactttttggctcatctcgtagtgccggacgtgtttataccttccgtggtaaacagtataccgttaaggaactgaagcataacgacgactttaagggaatcgatgttgcttttgtttcagccggaggtggtacttccaaggaatttgagaagacgatcacgaaacatggtacggtgatgatcgataactccagcgcgttccgtatggacgaggatgttccattggtcgtaccggaagtaaacccggaggatgccttgaatcgtcctcgtggcgtgatcgctaacccgaattgtaccacgattcagatggttgtagcgttgaaggcgatcgagaacttatctcatatcaagcgtgttcacgtatctacttatcaagctgccagtggagcgggcgctaccgctatggctgagttggtaaaacaatatgagcaactattaaagggcgaggagcctacagtagagaaatttgcttatcaattggcatataacgtaatccctcacgtagacgtattcacggaaaatggctatacgaaagaggagatgaagatgtataacgagacccgtaagatcatgcactcggatatcgaggtgagcgctacctgtgttcgcgtaccggttatgcgtgcgcatagcgaatctacttgggtagagacagagcgtccgatcagcgtggaagaggctcgcaaggctttcgccgaggctgagggtgtggtattgcaggatgaaccggcaaacaaggattatccgatgccgttgttcgtagcggatcacgatccggtttacgtaggccgtatccgtaaggatatcagcaacccgaatggtttgacattctggaccgtgagcgaccagatcaagaaaggcgccgctttgaacgccgtacaaatcgccgagtacttgctaaaggtgggtaatatcaaataacagacaactttgtaaattctatatacgtggaagcgggatcaagagaatactcttatcccgcttttttatgcttagcgtaattcctccatgccttctcaaaacgtataaatcaatacgcccaatacccgatggttggttatcgaatgtgtgtcatgaatccgtccgccatcttgcaaatccacattgccataccatgcgatggaagggctatattcaacacctaatttccagtgcggaagattatacgaaagttgcaggttggtcgtaaatacctgatctacgtccagacctacgccataggttttgcctaccagtgcctcattcgctcccaagttcttcaaatagcctaagaacaaacccggtttccatttctttccgtacacgatattcaaccaagaagtagagaagagatacggcgaatattcctgttcgccggtacgtgggtcgatagaggtgacgccgtaaccacccaacatacaagtctgcgtcaagttagaagccagcaaggttttcgccatcaccaaccaattcgcgtcctgatatttcacgtgcgcctcgccggatacggaagaaacccgctcgctgactttataaatcttgccatccacctcgttctgcgttctcggcactaacgacaagatttccataccggctcctacctgccaaccgggtttcttataatccaccccgagatagacttccggcacgcaactattcttgatatattcctcgctctttccgttcggtccagccgatagatattgcaactgccatagaaccgacccggtcaattgccacccattgtccgtataacgataacgaatttgcgggctgcggttaaagggctggaacggggcgccggtagaaagattcaacatctgtggaaagacctcgccaaatagcggatgccatgtctgtccgatcaagacagcggacttgccccaatccagattcacataggcatgacggatacggagcaccgcccaattgctacccgaaccccggaaatcggcctccagtttcaaggaagtcttggccgaaccaaccttcggtccttgtacatcgattcccaaacgggagtaaagcaggtaaaaactaccgttcggactagcgttcaagtccttgccatccgcatccaacgccacgtccttcggatataggtggaacaaaccatccacgatctcggcattcgcacgggaattatagaacaagtctccacgtacctgtccgtaaaatttgtaagagaagtttttcttttgcgcctgtacgcataccgccatacataggccgatcaaaagaagcaagttgcgtttcatttccattccggtcaatctatctttaaaaataatacatcatcaaacctaatatacgatgattcgttatcgcatgtgtttgctcgatacgtccgctctctaagtcggtcgtgccataataagctgtcgccggacaatactcgaaaccgaacttccaatgcggtaaattatacgatacgtttaagctgacggttattaattgatcgatatccaatcccataccatacaccttatccgctgagaccaaggacttcccggttcccaaattcttcgtatatccgacgaaaactcccggtctccatttcgttccgtaggcgaaattcacccatgtcgtagaatggcgaaaaggcgtatatccctgctcgcccgtacgggagtccaccgagctcaccccgtaaccgcccaataaagcggtatgatccaaggctgaggccatcaaggttttcgccgcaaaggtatagtttcttccgctatacttcaaatgtgcctcgtaagagaatgcggtcattcgctcgttcaccttaaaagtttgctccttccattccgtggaagtacggggtttcaaggagatcatatgagcgccgagccccatcaaccaaccatccgcaggggtaaaatccgcccccacgaacatctccggaatgcagctattcttaatataatcctcgctcatgcctttcggtccgctggaaaggtattgtaattgccacaacacggaagccatcaattgtacccggctattcgccttatactggtaacggatctgagggctacggttgaaaggctggaacggcgctccggtggaaagattcaagacatccggcatcacggcgccaaacaagggatgccacgtgatccctactaataccgccgattttccccaatccaagtttacgtatgcctgccggatacgtaacatcgtattactaccggaaaaaccgccaaagtccgtctctatcttagcggaggaacgagccttgccaatgtcgggacccgtcacgtccaagcccaagcgggaagtgaacgtatagaaactgccattcggcgtggcgttcaaatccttgccatccgcatcaaaactcttatccaaaggatagagataaaagttcccatcgatcggagccatattagcccgggaattgtagaaaagatctccacggacgaagccgtagaatttgtaagtgaagttttttctttgcgctgtcgtagaaaataaggctagcatccccacgagcaacagggtaatctgtctcattataattcagtttgttatttttcttaccttataagccgcgaatgtatatatttttatggattcaatttgaagaaacgaaatattatttgttcctttgcttccaagttgtaagccttaaaggtcaaattagattaatattgtaaacaccagataaagaaaatgagtactaaaaagtttttgctagaagaaaaagatatacctacggcatggtataatatcgtagcggatatgaagaacaaaccgctgccgatcttaaatccacaaactaaacagcccttaaaggaggaagatttatatcctctattctcgaaaggtgtctctcatcaagaaatgaacacgacagacacatggatcgagatccccgatgaagtacgcgagctttataaggtatggcgaccgactccgttggttcgtgccactggattggaaaaagcgctggatacgcccgctcatatctatttcaagaacgagagtgtaagcccgatcggttcacataagttgaattcggccttggctcaggcttattattgtaaacaagagggtacgacaaatatcacgaccgagacaggcgccggacaatggggtgccgctctttcttatgcggcaaaagctttcggcttggaacttgccgtttatatggtaaaggttagttaccaccagaagccctaccgtcgttcgatcatgcagactttcggagcacaagttgttgcctccccgagtatgagtacgaaagccggacgtaagatcttgacagaccatcctaattatcaaggtagtctaggtaccgccatctccgaggcggtagagctggccatgcagacaccgaactgtaaatatacattaggtagcgtattaaaccacgttatgctgcatcagaccgttatcggactggaagctgagaaacaaatggaaatggctggcgagtaccccgatgtcgttatcggttgtttcggtggtggttccaacttctccggtatcacattcccattcctgcgccataaactaacggaaggtaaggatatccgggttatagcggcggaaccggcatcttgcccgaaacttacaagagggcaattccaatatgacttcggagatgaggcaggctataccccattaatcccgatgttcacgttgggacataatttctctccagcgaatatccatgcgggaggtttgcgttatcatggcgccggctccatcgtcagccagttgatgaaagacgaattgatgagcgccgtggatatcaagcaattggataccttcaaggccgctaccttattcgcacaagcggaaggaatcataccggccccggaatcatcccacgctatcgccgcagctatccatgaggcagagcaagccaagatcgaaggtaaacctcgtacgatcttgttcaacttatcggggcacggcttgatcgatatggccgcctacgaccaatatctatccggtgatctaacaaactatgaggtaacggatgaggaagtagctaacaatttgaaagatttggagaaaatcatctgataaaaacaagaaaaggggcgataccaaatcgcccctttcccctatttgtctatgaaagtcttaatttaaagtatgtattatgagaaaatttcttcgtaattagtactcgggataatcatgttctggacatttaagctaaagtttttctttttcttatcccacataccgtaatttgtctttatctctccactttgatcatcatattgataagtgatctgatagaatggaacccattcatcgtttgtccgatcccaacgaaacgctttcttctcggaaaccttgccgttctcgttgtactggaactcatatcttacctgtttgttcaacagtccgttttcctgtaagaataccactttagagataatcttaccattctcctcttttgtatcatatagataatctttaggagacgctgcgcttatcgctaaactacacatgaaagtaaaaacaagcgcaagaatacttttaccccaaactgatgtcttcatactattttaatttataaggttactatcattttgtaccgcgaagtaaggaagtttcccgacaatcaccaaaagcaaagtgacaaatcgttagtaatatcacaatatttaacacattcaagaccttcattcccttcgattctcccatgtttactgacatattgtaaaccaaatcgtaagttcccccgatttttaaatatctattatttaccaccagccggatgtaactttcaaaagaaaactttagacaccgcttttttaataaattaaaaatctattgattaataaatatattcttacttttgcaaaggcagaatgcaaattgatttcttgacatgcgacaaataatgaaactatttatcacatcctttctttttatcctattctcaggatgtacaaaggatgtatatgatccttccaataaaattccgggagaaggtactaatccattctcaaaggtaacaatttcctctaatttcgattggtcgatgatacaaatatcccaccttaccgtacaatctttcgacccctatgatggcacctataattatctggtagaagtatttgataaaagtccggaagatcaagatgcgaatcttctcgctaccggggtttgctcaaagaaaacgcttttcgataagaaaattatctatccaaagggagagtcggatcaagtttacatacaattgacgacccctaccggatatcaagttaccgctcctgtcaccttaacaccgggtaatgataatgtctgtgctttcgattcgttagccgtatcgcaggaaacaaccgctactccggttagccgtaccccgacccgaagcgtgtcttccacctatacatttataatagaagactctttccctaattacggagattatgattttaatgatgccgtgataaaagtccagatggaaacttccatgaaagacgattatgtacaattcgccaatataaaactgactttccgtgcattaggtggaactaagcgggccggagctttcatccatctccccggcataaagtccaaagacatccaaaaagccgagttaaatggctggaccacgactccagaatcggaaaccgagactccggtttatgccctatcggatgatatacatggattattctcttttcatgaaatgattaatacagataatgaccttccatataggggaaagcaagaacgtttgatcaccttttcgttcgcagccggtgccttaaaagatttgaccattgatgacatcgatcttttcacgaccgtattaaagcgggaaggagaggtcttacgcacggaaatccaccaacgtaattatagctatacccccaaaggggtcagataccgttattactcaaatgataattgcatatgggccttaatgataccggatgatttcaaataccctgtggaacatgcttttattggtgatgcctatccggatctattgaaatgggtaagtggagatagcaaacatgtacaatggtataaaagtaagaatacggttgataagtggatttatacccgagaacaataacaacctaaaatcctccgtaaaatgaaaacgaccgccatcttatatcttgcctatctggctttatgcgttcagtgctcagtgccggaaaacaagagcacgaaaaaagagattaatactcaaccgataaaggtgggtgtattcgatgggcatggaggagcacagacctgtatttgggaaactgtcgccgctatccggctggacccggaaatggaggtacgtaccattactacagcagatatagctaataatgtgctcgattcgatcgacgctattattatcccgggaggaagtggcaaaagtcagtacttaaacctagggaccttaaatcaacaacgtatcaaggacttcatcgctaaaggtaaaggggctgtcgggatctgtgccggagcctatctattctcgaatactcccgattacacctgtatacagctaaatggacagcaagcgatcgacatcgagcatgacaaccgagggcatggattagcgaaattcaccttatgcgaggagggtaagaagatattccccgaattagccgaccgcgatacgagtttcgtcatttactatgagggaccggtatttataaacaatccggctgatacgatccaaagcaacacgcttgccatcatggaaagcgatgtgcatgaggaaggaaacgccccggctaatatgacaaacggtaagccattcttcgtagccaataactacgggaaagggcgtgtttttagttccatcgcccaccccgaaggtactcccggcatgatgtggatgatcccccggatggtacgttggaccttgaataagccttttatcccttatcaatcctccgccgtacgtccagacctgttcaatcatgaatcattaatggctaccgatgatttaaagcaggaagaaaaagcctttcaaatccttttaagcggagaaagcgagcaaaaagttgccgccttggattggctggaagcacaccattcatgggacgccaaacgatgggtacaaggattgctttatgacgcttcacccgccgtccgtatccgggcagcccggtatatagcggatacccattacttaccattcttacccaacttacaggcggcctaccggacagaaaccgataaggcaacccaagaagagttaaagacgcagctggagaaactaacagccttacttccttaggctagggagatttaaactctccctagatattcatctaccgtatagtttaagaaacgattgaatggtaataacaatttaaagtcatccaccgccttatccatccaattcttagcgtaaaagaaattatccggcttataagacaccacgctgaaatccttatgcttcatgatataaccataaggggaatccattggatagccggcaggcatgcgtttcagcatctccccctctaacaccgggaatgttttcttaaatgtaggttcctcgataatagccgtaaattcctcgatatgatcgtatatatcctgacgaagtttctttaatagcgcaggtggcgggcaccatacaccaccggaaagcaagcaacctcccggctccagatggatataataaccaccccgttcgctggcacgaccaccttgggagatgtaagcggcgaaatgacatttataaggagtcttatctggagagaaacggatatccctgtatatccggaacaaacaatctttcgcctccaacccggctacctcgggatcgaataaggagatacgaccgattaaatcctgtacctcatcaataaaaaccttacgtagcgcatcgtaacgacttttattgtcttggaaccattcccgattgttatggctcctcaactctgtcaagaactctatgatctgttcattcataactttctatttttaatccttacaaatgtaagaaatattagaaactgtaacccagattcagataaaattgcaggttattattccggttcgacaatccgaagttcgtattcatcggaccgactatactgttataagcataaccgatgctacctccccaaacgctttctcccttgaagagatcgaagaaattattctcatggatcgcataattagcgatcaaagagatataatgccgttgcccgatacgctgacgcaagtttaagcggacaatcgccacggaattatcgaatatctccatatggttgatcccggcgaaagggagttgctggggaagataccgttccggcatatcgcctcccaccacattcaaaaagggataagccggatctttcccgatcaacacacgcccatcgatggaaggcaacaggctcaaatgggaagtcagcggcaataccgacaggaagctgagcttcaaggcggagaagaatgtatgtcctttataggtcacgaagttatccgtataaatggaataatccgcttgcagagaaacgcctttactcgggaagtaacgacgatccaacgtctccagatgggcttgagcgaaatagctgataaagccttccggttttacttgatacttttggttttccgccgtataaaggaatgagttataatcgaaatactcataacgggctcctagcttcaacttgaaattcagccagttcatatccgaatacccgagttccacgaaatgatggcgatacgtcgtatttacgatcttatttcccctgttatacacgtcgaggtcatggtacgtgaacatgtaagacaggttaatattacgcaatggattacgctctatcgcatagtccacccgcccatacatacgtttcccgatcctcccggttacggagaacttcgaatggtaacgggcccgattgtcaaaagtcacattcagcaatagggcgacgatatcctcgctattgaaattcaggcccacattaatcgcgctatttgatttttcctgtaccgtaagcaccaaatcctcctgcctctcgccgactaatttatagcttacattcgagtaaaggtttgtaccgatcacgatagacatggcttcctgcaatttcttcacggtaagcaagctattctctttcaagccgctgatttgcgtcaaccatttctcatcacgaggatctataccttcaaacaagacacgccggatatgaaacgtatcggtaggggctaccggataggaatgtactaatctctttcggtgcatatccgaactatcggataaaccaatcttcttctttaaggcaagaatctcatcccattgcttgcgggcgacttgctcaccccggtcaatcaaggtatccaaggccgtctccccaaaactagcggaattataagggtctgtattcgggcggaacaacagatcggtctgttccttattcggtccgtatttctcataaccatgcaaggcgacgatctgccctacgatatcccaaggggtatttatccgctccaactgtttcaagtcgctagtacctagatctacgccaataatgatatccgcccccatatcccgtgcgacatccgccggatagttattcttgatcccaccatctaccaacaccatgctatccaaacgtaccggcgcaaacacggcaggaatcgccatactggcacgcatagccaacggaagacttccatgatggaaaacatattcttggccgtccaccacattcaacgccacacaagcgaaaggtatattcaattgattgaagtccacggaatcatgatagccgatcgttagattcgagaacaggttctggagattttgcccttttatcatcccttggatcgctatctcttttttactccgcccaaaagggagtgagaatacataacgctcggaattctctttctccggaaaagtaaggctactacgtttcacccggtcgctcaataacatactccagtcctgcaatctcaccatgctatcgatttccgcagcattatatccaacggaatataagccccccacgatagctcccatactagtgccggcaatataatcaatcgggatgccggcctcctccaataccttcaacaccccgatatgagcgacacctttcgccccaccgcctcccagcaccaagccaacctttttccgctcagccatcacagaaggcaccaacatcaacccaaccaaccacaataaaaggaacttcctcatctagatattctttccggcaaatgtagctggtttactcgaaaacgcaaacggattcatctagaataaaacgtatgtttacctatatataaagtttatcgctatctcatctattctataaaccatgccgtgaactgtataaaccaaggcgtggtctgcacattccacggcgtggtttatacagttcacggcgctgatttaagaataaatacttattcgctatggaatgtataggttatcggagaactatttcaacaagagaggaacattttatttccggaacataagtgggcaatcgatagtatttgatacggcctccctaaaattaataggcatttctcgctaaaatcgatttacgtattatgaatcaagtatgtacgtgtttatcaaaaaataatatagccatcaacttacttttttccagcaaggtagcagccggagcaatatattactttttctttttcagcagcatgaccacaggattcgactcttcatccaagtttgcggcgatctccttcaactttccttttagctggcctttctcgtaagcctcaactaagtccggggcatctagagtttggcagatagctatttcggggtttcttggctctgatgttagagagacttcttccttattgatgaaatcatcattgtatagaatatagctgaataaggcattttcttgtttatcatacaccagatcttcaccaaggaaacctttaaacgtcgtaaagtcaacctcttttctcatggttctcataaaacagtagcgatcggtgataacggttggaaaaagaaagactttcgtatccatggaggatatggaagggcttcttacgataaaaggactcagattaccatccggcaagtaatggaatatggtatcagacgatgtattgacaagtatccatttatcccgatccgggaacgtaagataaaattccggcgtaatgacaaactccccttctgtcacaaccggagtctcaatacccttagagggaatctggatctcatgggtgatacggccatcttgtttggaaataatcaaatggcactcccgcttgcctttttccgatggataactcttatagcaaatcaaatgatcacgatcataattaaatatataattataataactggtatccgtgaacttaaaactccttttatagtttcccaataagtcatagacacctatttttctcgccggattatccttgacgaatatctcatcgttatcctcatccaagacaagccctgtaagctgcgtgtattcctcaccgctttgccctaaacggtttatcttcctaagtccctttccgtttttatcgaaaacaagaatatccccatcactgccccgattcgtcaccagcatgatatcctttccgatcgctttcacggcacctttagttataaaatcatccgtggtttccaacgcaatgtattccacgtccataagatcttgaagtatcaattccttttccggataatcggccatgacatcaacccttataaggttatcgacagaggaagcggaccgattgccacatcccatacatccgactaaagcgagtagcatagccactgcgttcgtagttaattttctcattttttatgatgtttaaagtctttcgttcgatgtcatttcttgctctttagcattttctcccgatccatcattcgtatcatctcttttacctcatcggatgtctccggcagttgattgatcaggttacgcaaatccacgatagaaatcttgctctttttcccatccgggtctatcatagtctcctccgccacattacggaaaaacatatcttcatagaaggattgcagaagcgcccggctaaacaccatcgtcctctcgtccgcttttttctttaagctctcattcatataaagtaccaagataaaaagccctcgctggcgatcctcctcactctggaatttagacacgtcaatctcactatacatatgcgagatcgccgccaggaaatccagtcgttccggattcttcttccatgcctcatagtagagacgggacgcttccttatatctcccgtctttttggtaagtctccgcacggaaggccaataattgatttaccaagaaacgattgggctccaatcccttttccgcccggtcaaataagtcgtaagcccgcttccggtcatatgtcttacccaaggcggaacccaataagaggcatacctcgaccgaggtcgtatcctgctcataagccatatccagaatatctaccgagggcatatacagaccggcataatacttcgaggctcccccatatttcaaggtaaggtaagtagaatcaccatcagccaacaaactggaatagacagaatccgcctgaacaaattgtttcacggtatatagccccaatcctttactacgcaataattgacgattcccgggattataaaacaaggcggtatcgcaaatcgctattccttccgatatataatccgggctactagcccccatccgatacaatgaattcactaacgcaaccgccaaccccgcattctcacgattcaagttatacgcctgaaaataagcggtcgtagcggaaggatattgttccattcgagtatagcaatcgccaatcgcacggtataagacagtattatcctcattctgagcttgcaatttctcataggcatcaactgctttctcatactcccccaattggaaatacagacgtgccaactgataattagcgtagaagttcgagctatcggcggataagacctgatgaaaatatcgctcggcatcctccgcacggcctaagttcgtcgccgtccgagccaagatgtttaagatatccaagttcgtcgtatccatagaaaagcaaagacggtaatagtcataagccttctgataccgaagcataccctcataagcctgcccgatagcgttcataatctcataattcgaagaatcggctaatgtaaggctatcagcatgagcgatcacagccgcatattgcttacggttcaccaagtcttgccaattaaactcttgagcattcccgggaaaaataaggcaacaaagtaacagaactgtaactaaattacatttctcattcatatctgtatgtttttaagattactgattaagcgaccaacacagcctctattcttatttcactgtaaccggaaagtaataggcaccgtatataagacgcggaccgcctttccgtcctgacgaccgggagtccaccggggcatcattccgatgactcgcaaagcttccgcatccaaggagggatctatcccccgtatgattttaggttccacgatatttcctttcttatctaccacaaacgaacagatcacacgaccttgcactcccgcttcctgcgcatctgtcggatactttatgctttgagcgataaacttcaataattcacgatcccctccgggatattgcggcatcacgtccactaccgtcaaagtctcttccttcgcttcttctaccggacttttcaaacggaacgtaatcgggaccgtatatttcacggcgaccgcctttccacgttgcattcccggattccaacgaggcatagtgtttattacccttacggcctcctcattcaataaaggagtcactccccgaagcacctccggattattgacggaaccatcacgcccaacgataaacgagcagattacacgcccttgctccccgttatcctgactctctttcggatactttatattcgtggctatgtatttcaacaactccgcatccccacccggaaaactaggcatcttctctaccacggtaaatacttgctcgttcatctcacgggatttggaagataaggacaaatgggtattatttgtcatatcagcagccaagacctcttgagactcccttccttgatagctgcatcgcaaaatcgcattcgcagggacctccaaagagaaagcccctttcttatccgtgatagtcctctctttaccgcccttcaccacaactgatgccccgatcaaaggctgcccggtctcatcaaccagaatgcccgtagccgtcaccatagcgttcgagaccgtagcctcattcgccagacggacagtcaaacgggctaccgcctcgatattacttaacagcatcaagatccctaccaatggaataaatatcagatatttcgtacgtacgatacccgggctccgcttcttgttcatcatcataatccggttcttcagatgcagcacattgaaactattatacaaagtagtaacggactgatgatgagccaatcccaataaatggtattgatagctcttactatcgtaaccagactggatcaccgtgttatccgccagatactccagattatgcctaacctcacgcttcaataaccatacaaaaggattaaaccagcaagccatacacatcatctcgctcaagatcacgtcaatcgagtgccattgggatacgtgcgtacattcatgtgtcaatatctcatccgtttccttatccgaatgactctccggatgcaagaagaccatacggaaaaaggagaatggcccggcggccttccgcaacgcataaaccggagtttcatgaataacaacacgctcactggtatgagccaaccataagatactgcttaattgcacgagaaaacgtccgcataagaacgctacgatcccccaataaataaaccccaaagatcccagcaaccatccatgccaatccacggacgccgcggcatccgctttcgccgtcgcctcaggcaacatagcggaatacatataaatcacatctgctataggctcttgttgccttacccaatcttggatgttcagcaaaggataaaacagagccaagccaaagaacgccagcaatatcgcacgacgtagcttgaagaacgtgtccttatagaagaacaaccggtagaaggcgtaaaagagtacaaaggctacatttaccttcaataagtaggcaaattccggtgtcatggtatgtgggatttaggttattcttttcctttctcaatcaaatcgatgatatcctttagatcatccgtagagattttctgatctttcgcaaagaaagaaaccatttctttatacgagttagcgaaataattcgttaccacgccgccaaggaacgtacgtttatattccgtttcctctatcaaaggacggtattcatacgtatttccataacgtttcgccttcacgtacttctttcgctccagattcttgatcacggaagcgagcgtcgtataaggaggtttcgggtcctcgtatttggccagcacatctttcacaaaacaaggaccgatccgccaaatccagcgcatcgcctcttcttcctgcatcgttagcttctccataaatcttatccttttattaatgtatatccacaaagctacgaaatagtcgtaaacggcatgcggaaggcacgttaattaacattaaataagaatcacaagacctgcaatcgtgaattattgcaacttaaatgtgatcggcaccgtatatttcacggctaccggctcgcctctttgcgtgcccggtgtccaacgaggcatcatttgcaaaactcgaaccgcctcttggtctaatgccggggagattcctctaatgaccttgtaattcgtaagtgttccatccttcgttaccacaaacgaacaaatcacacggccttgctctcctttgttttggctttcttgtggatactttacattcttggctataaatttcaaaagctccgcatcaccgccgggaaacttcggcatcacctctactaccctaaatacctgctctccattttccagcgtatcttcgtcctccgcttccacctgtacttgctcttgtttttctgcctttgttacatctgtcggaacactttcttctttttgttccgaagactgtccgcatcctacgcacatcgccaaagcgaacaggatgatcattgtgttcataatcgcctttttcattttcaatcagttttaatgttatttataccgttattacacatacttaccaacctctaagcatatccggatattacgtcggtttcgcaaacatacgaaatactcgtaatataaatataaacaatatgttaaataacactaatagccatcaaagacatagaaaagataaaagaacatagcttctatcgctagattattacaagaagtacaaccgagcgatacatatcgaagtcaaataagcgaatagaacacaaaaaccggattgccctcctctccttttaagtccaactcctgcggaatcgtgatcgagtgaagcgacttatataagtttagctcatacggggtcactacttgtaccaactcatcttttatgaccctcccccagaccgggaaattccgataacttctcgtaccctgcatgccatgttgaaggttcgcgtccgccagttcatagatagaccccggcatctcgcatttttccacgagtgtctttcccgtctttttatccacagaggcgatataatagccttggttatacaataaacggaaataataatgtgccggaaactcaatcatatcttgcacaaagatatccttggggtcctttttttcaattcgcaaattactcatgtccgtaacatccaacgaacgaatcacttccgcatccgagtttttcagatcaaggacacaagccgcacttattcgatccgccgagatacagaagaccgtatcattactaccggtcttaaacaacacggagttttgcgcatcagaataagcggaggcgatacttgtcgtgaacccgctcttctcatggggtaataaaaaggaataaaaatcattcttgatcgctatcgtatcccctttcctcgaaaataggcccaatccgaatccccctccgttgaaaggctgaaaagggaatgatatggcggcgaaacgatcctttccgatatgacgcatatagattaccgaatactcatgggtggattgtccgataaattcaccttctaatgtatattcccaaactcgattattactaaataaaaaaaggcgatcattacgttcgtccacttggatacatggcagaataccgctaaattcacccggtccctgcccttcttttaccaacgtccggataaaacgcccttgccgatcgaacaggacgatacggggctcttttacgggaagcacatagatatatcgatctgtcacggcataatcataaactccgtctatcaacgaggcatcatccgtggtcacctctaaagggacaaaagtaacccccttgatctcatcgcctaattccaatagccccggtttatccatcccccctcttatatccgcggttaaaagagaggacgcttccgttggcgaagaaccgcatgacacgaaacaagaaacgacaaaaacactatttaaataaaacaagatagaggctaactttacacttttcataaccatgcttttttgcctccaaaaatatcccgtatatctcacaaatcacataataaatgagaacaaaaatgagaacaaacctgccaagaccgctataaatatataataatcaaaagtttgatataaactccacaaatgcctccgtagaaccttctttcttaaaaatcttccggaatagacgaggacgaagtaccgaactattatatttcaatacccgtgtgatctggttggcgggaacaccgattttcgtgagcatacaggccttcaactccgtatcggaaataacaggatatagctttttcagccgtaaggtaaagtcatcataagccttattcaacaaaacctccaaaagctcccaatcctcagagataatcttgccggcatcccgatcgtgaaacttctcatagacctccgatttccgcaagatcgcgacagataataaatgcttactctccttattaagaatcgactcgttacaaatttccagccgttgtttttccaattgtaaggaaaccaacatcaactcttgatccttttcttcctttattttcgtaattcttttttccaaaagggtgatttgccgttcattctcttctttttcttctcgcatacgttgttgctggctagcaatcgaacgtcgcaaggcttcttcccttcgaagagcgttttcctgcgtatttctccatcgccgataaaggaggaagcaaataaataggattatgccgataataaatgcgtacagataacgctcctgtcccctttgtaatagcatcaactctttcttagacaagtcctcacggatcggccttacatcatagcgggaagtgatctgataaatcgattctctcgctgatagtgatccgatagaatcccgtaacatctcgtatttcttgacctcggtcagtatccggtcttgtccggccgcatcgttcaataactgatattgagcactcgcttttctcaaaaaagacatagccttgccatataattcctgctcggcgtacagcatccccatttggttatataaccttccccagaattcataatcccaattctctccctcatattccaacgcacgtaaatagcattccaaagctagggacggttgatccatatcctcatagactttcccccggtaaaaccaagctttgggaggccagtaacagcctcgtgtcgtcctataataatccgtagcgatagagattatggaatccgatgtatgcctcaatcccgcctcatcccgtgattcggtccataacagacaataacgggctttctctcgaagcgataatccattgatatccctcactttctctaataacaccaaagcactgtccggatgatgcggaatcaatttctctacctgccagaacaggttgccatgcttgtcgctcctatatgaaaaaagcacaagaaccaagatcacgatcgtaaataataagatcgtaaacttgatccctatggaaaaatgccgtgacccattcaaatccttacgcatataggcaaatgtatataaattattcataaggaaagccttttccttccgcattattccatgtgtcgggacacatgccctgacctctcccattaatgcagaaatatttctttaatcgtttgcgcaatatatggatttagcatacctttgcgtgataattacatagtttaagtagaaatttctaaatacaattaaataacttaaattattatcttatgtggttacttaattcttctatcgggaagaagctgataatgagtatatcaggcctctttcttgttctgttcttattgttccacctgtcgatgaacgtggcggccgttttctccggagaggcttataacatggtttgttcgctgttgggctctaattggtacgctgtggcagctactctcgtattggccgcaggcgttgtgatccacttcgtgtacgctatcattcttaccttgcaaaaccgtaaggcacgtggtaacgaccgttacgctatcaacgctcgtccgaaaggcgtggaatgggcatctcagaacatgttcgttttgggtttgattgttatcctgttcatgctgttgcacttcagccagttctggtataagatgatgttcgccgaattgatcggtcatcacgaagttgcattggggtcagctatggtatctccacaagacggagccgcttttatcaactattacttccaaggtaatgccgtgatcactgttctttatttgatctggtacgtggctttgtggttccacttgactcacgggttctggagcgctatccaaacaattggttggaataatacgatctggatgaaccgttgggaatgtatctctaagatcgtagctacggttatttgcggacttttcgcgatcattactatcatcttcttcctaaacggagtaggtgcttaattgcaagctacaggttttataattaagaacttttgaaattaaatcattatgtctgaaataaattctaaaatacctcaaggcccgttggctgagaagtggactaattataaaaatcaccagaaattggtgaaccccgctaacaagcgtcgtttggatgttatcgtagtcggtacaggtttggccggagcttccgctgccgcatctttggcagagatgggattcaacgtattgaacttctgtatccaagattctccccgccgtgcgcactctatcgccgctcaaggtggtatcaacgccgctaagaactaccagaatgatggtgactctgtttaccgtttgttctacgatacgatcaaaggtggtgactaccgtgctcgtgaggctaacgtttatcgtttggctgaggtttctaactcaatcatcgaccagtgcgtggctcaaggcgttcctttcgctcgcgaatatggtggtttgttggataaccgttcattcggtggcgctcaggtatcgcgtacgttctacgcccgtggccagacgggtcagcagcttttgttaggcgcttattcagcgttgagccgtcagatcggtttgggtaaggttaagatgtacactcgtcatgagatgttggatgtagttaaggtagacggtcgtgctcgtggtatcatcgcccgcaacttgattacaggtaagatcgagcgttacgccgctcacgctgtagttgtagctacgggtggttacgttaatacgttcttcttgtcaaccaacgctatggcatctaacggttccgccgcatggcaatgctacaagaaaggcgcttacttcgctaatccttgtatggttcagatccacccgacttgcgtaccggtgaaaggtgacttccaatctaaattgactttgatgtccgaatccttgcgtaacgacggccgtatctgggttccgaagaaactggaagacgctaaagctctacaggccggaacgaagaaaggtaaagatattcccgaggcagaccgtgattattatttggagcgtcgttatccggcattcggaaacttggttcctcgcgacgtggcttctcgtgccgctaaagagcgttgcgacgcaggtttcggcgtgaacagcacgggcttggccgtattcttggatttctccgacgcgatcaatcgcttgggtaaagaggtcgttaagcagaaatacggtaacttgttcgatatgtacgaagagatcacgaacgataatccatacgagactccgatgatgatctacccggcattgcactactcaatgggtggattgtgggttgactatgagttgatgacctccattccgggtctgttcgctatcggtgaggcaaacttctccgatcacggagcgaaccgtttaggtgcttccgctttgatgcagggattggccgatggttatttcgtattaccatacacgatccagaactatttgtccgaccaaatccaagttcctcgcttcagcacggatctgccggagttcgtcgaggcagaaaaggccatcaaggatcgtatccaaaaattgatgaacgtcaagggtaaagaaaccgtagacactatccaccgcaaactaggtcatatcatgtgggaacatatcggtatggcacgcgacgcaaaaggtttgcaagaagctatccagatgctgaaagacttgaagaaagagttctggagcaacgtattcatcccaggcaacgcagacaacttgaataccgagttagagaaagcattacgtgtagctgactttatcgagatcggtacattgatggcacacgatgctttggaccgcgctgagtcttgtggtggtcacttccgtacggagcaccagacagaagaaggtgaggccttgcgtcatgacgataagttcatgtacgtatcttgctgggagtaccaaggcgaggacaaagatcctgtcatgttgaaagaggatttgaactatgagttcgttgttcctcaaacacgtaactacaagaagtaataatcatcaatctcagaaaaaattagaatcatggataaagatataagtgtaacacttaaggtttggcgtcagagaggtccgaaggagaaaggacagttcgagacatacaaaattgagaagatcaatcagagtgtctctttcttggaaatgttggatatcttgaacgagcagttggtcaacgagggtaaggaaccgatcgtattcgatcacgactgccgcgagggtatctgtggcatgtgttcattgtatgtaaacggacacccgcacggaccggcaactggagctacgacttgccagttatatatgcgtcgtttccacgatggagagacgatcacgatcgaaccgtggcgttccgcaggtttccctgttatccgcgacttgatggtagaccgctacgcttacgacaaaatcatccaagcgggtggtttcacatctgtcaacacaggtggtgtacccgacgctaatgcgatacctatcccaaagaaggacgcagacttagccatggacgctgccgcttgtatcggttgtggcgcttgtgctgccgcttgtaagaatggttccgctatgttattcgtatccgctaaggttagccagctggctttgttgcctcaaggtaaagtcgaggctgctcgccgtgccaaagctatggtcgctaaaatggatgagcttggcttcggtaactgtacgaacacacgtgcttgcgagatggaatgtccgaagaatatctccgttagcaacatcgctcgtttgaaccgcgagttcatttgcgctaaattacaagactaatatttgattagtatatcatggaaaaggcgtctttctctaaaagaaaggcgcctttttgtttttgttatatgtcgtaaaacataatttagcattataatccttgacaggaattgaaaagtccgtatatttgcatcgtggttttttcataatagtattagatttaaggttaacaaagtttggttagggcttgtcgtgagacaggctttaattgtttatagacctaccttttaaacatggaccataaaatactgcaaatagagattgtttagcgtcattttatcgtcgatctttgcctttaaagatcatatagtatatgctaataagtattttatttggcttcttatgttattttctccgggtgttgatcaaacacaaggaaaaaatcatgcgccagataagacaaatggtaaaacaaaaataaaatggacaaaaaacgaaccaccagttctttcagggcaatgagcacggaaagaaaactcgagtcgatcttccttttcgtaacaggccgatgcaacgccaaatgcgcaatgtgtttctatgcccaagaaatggataagaagcaacccgacctcactttcgatgaaatcaagaagatatcagaaaccgccgggcaattcaatcgattatggatatccgggggtgagcctaccttgcgtgaggatctaccggaaatattggagttattctacaaaaacaaccatatcaaagatgtgaacatccctacgaacggcttaaaaccagaccggatcgtcgaatgggtaaaacggttccgccagaactgcccggattgtaatattaacgtaagcctttccttggatggtttcggtacgacccacgatacacagagaggcgtaccgggaaacttctataaggccttggaaaccctgcgtaagatacaggagaatttcggagatgacggcaaagtcttaaaaaatatagcaaccgttatcacgaaatacaatatagaccagatagaagacttcatgacttgggtatacggacgtttccgtacctccacgcatacgattgaggctgccagaggcatgacccgtgacgatggcgtgaaaatcctaaccgagtcaacgctacgcaaaatacaagatgacatatcccctatctattctgcttatgcggatcggatggtagcggataccaccggcttaaggaaaccgatcacacgcttcttctatctcggccttatacgtaccttatataatgtgcgtgccagcaacatagatcacccgaccccttgggggatggattgtacggccggagagactaccttggtaatcgactacgacggacgttttcgtgcctgcgagctacgggaaccgctcggaaatataaaagagtatggttgcgatataagtaaagtgatgaatagcgaagcgatgaaacaggaaatagtcgctatcggacatgggtataaagccaactgttggtgtacgcacggctgttggatcacctcatccatcattttcaatccacgtaagatgattcgctccgtatataaaggataccgggaaacaaaacgattgaatcatcccctagccatcaatgagcagaaactacaaacgatggaagccaaataccatctggacatcgagcgtttgcgtcaactgaatatccggtaaacaagatcctcatagcccataaataaacgtagcatgaaaatactattagtaaccagaggctcacaaggcgacgtccttccttatttggccatagcggccgaattggaaagacgtggccatgaggtgaccatcaatctccctcaaatattcgaggagaccgttaaaccctacggatttaaatacgtattgcagcagtttgacgatatcggcggcatgatcgatagcgcagcgcaaaactcacataaattccggccattccttaaatggatgaggaacgtgatcgataaacagttcgatcaattgattcccctactaaaagagcatgatattttagtatcgaccaactcggaatttgctgtcgcaagtatcgccgagtattgcaagaagcccttgatacgtaccgcctacgccccgttcttgccgggtaagaagattcccccggccgtattgccatttcccaaacccaacccgatcatcacccctgccatcttatggaagttgatgaaccggatgaccaatttcatggtcaaagacacgatcaacaagaaccgggctaaatacggactcgcaccgattcgtaattttggttatcatgcgggagagcgttcatataattacttgcttttcagccagcacctaggaaacatagatccggactggacgttcaaatggtcgatcggaggctattgcttcaatgacacttttcaatatgatgagaaggcttacgaggaaatgatatcattcgtcgacagcgctcaaagccctattatcttttttaccctcgggagttgtagttccaaggatggtaaccgttttagcaaagccttggtcgatatttgcaagaaacatgattatcggctcatcatcggttccggttgggcaaagacaggaatcaccttacaagcggataaacatttattcttaatgaagcagccggttccgcataatttgatatttccgcactgcgacggcgttatccatcatggaggttgcggcacgacccatagcgtaggaagggcgggaaagccccaattaatcactccgttgattatcgatcaaccctattggtcctatcgaatccaccaattagggttagggccggaagggcttaagatagcgaaagcgagcgagcaggagatcgaacgcaaggtttgtgatctggtcaccaatccgctttataagaaaaatgccgctcatataggcgagatgatccaaaaagagggaggtataaagaatatatgcgactctatcgaaagatttcaatgaggcataagttcctattagattttattacatgttacaaaacacaatttagcacttaaactattgacaaataatagtaactccgtatatttgcatcgtggttttttcataatagtattagatttaaggttaacaaagtttggttagggcttgtcgtgagacaggctttaattgttttataaggtctgcttcccgcaaagcccttcgattacatcagaataatccgatgcgtcaataaagttgatatcttgtcttttaagatcttcccattaatcggtttcgccgtataggcatcaaatccactattaatgatccgttgctcatcttgggcgaaagcataagccgtcaccgcgataataggcacgctagcagaaaccttacgaatctctgcggtagcctcgtatccatccatgaccggcatctttatatccatcaagatcaactgaggtttgtgctgataaaatagctccacagcctcctttccattccatgcatgaatcaatttatattcaggcttcaatatagactcaaacaggcgataattactggaattgtcctcagcgatcaagatcgtaacctcacttcgggcgatcttctccaaagtaacaggcttctgctcttcactaggcaataattctttcttcggctgaaaaggcaatgtaaaccagaacctagagcctttcccttccacggaatcaacccctatcgttcctttcatctgggtaacaatcatctcacagatacttaaacccaatcctgttccttgagcgaaagtgttcagtttcacaaaacgtccgaaaatatctttccgtttattctccgggattccgcagcccgtatcctctacatagaaccacaacgtattatcatccttcaacttatagccaaataagatcgatcctgcctgcgtaaatttcatggcattgttcaacagattgatcatcagttgggacagacgatttcgatccgtataaatcacgcaaggctccagataatccttaaatgagatctgtacatccggattcttattcttcaaatgagccgattgctccaaatccctcaatacagcgttaatatccacatagtcataagtaaactccaaggtacccgcctcgatctttgacaaatccaagatatcgtttatcaactgcaacaatagggaattattattctcgataatatcagcgaattccttcttatcctcaaggtcatcggtcgaggcaaggatattagagaaacctactatcgcatttaacggtgtacgtatctcatggctcatatttgctaaaaacgctgatttcaatttattcgactcttccgccttatccctagccattcgaaggtcatgttccaattgcttacgctcggtaatagatatcgtagacccgatcaacgctttcggtttaccggaagcatcatattcagccattacctgtatctcctcccactcatggcgatcttctcccggaatcaaccgctccagacaatattcttttcgtactttctttattttcccattacacaaatcatcgaaagccttttccacgcaagccctgaaagacgggtgtatcttgctgaaatattccttcaacgaaacctcatgggtatgcacctctgctgtctctatattatctcccggatgtactttcgactcatagataatcttcccttcagccagattatatcgccacggtaaaagatctgccgcctctaacgccatagccagcttatgattcatggctttcaaatgcgtctggaaattatggatatccgtaatatcaataaaaaacgcatcaactacattctcttccgaggtaggcatgatgataatcgtatagtaaagccctgtcggctcaaaataatactcacaagtaaaggatttcccactctccagaactgtaggcacagccgatagaagcaaaggataacttcccccaattaaattagcgatctcttttccatgcttatttaccacgaaatctttaggagcgattttttcctcgaaagcatggtttacatccaaaacctgcacatcgatttgcgtaccttcccgaatcagccgctgccgtatataaggcaatggcatattattaaataaatcacggtaacgggataatagcctcaactccacttccttcatcttttgcttagaacgatacacgtaatgccacgctaaaaacactactaccagaaagaaaatcagaaagcctaatagcggcatccaatatttttctaaaaaagagggaggcgcattcaaatagatcgcatcatgtgggaaattatcttcattagacatcgcgctcatcagcgaaacataattcaagtatttacgaggatcatccaccgttgaaaccgggatcttgcccatatcttcaccgttataaacttgctgtagcaagggaattagagcagtctcaatcgttttagcgctattataatatccaccaatcgtatatccttcttccacgcccatatcatataaagaaaaaacaggatgcctagaaatgccgtttataccttgatacaaagtactatataataacgagtgattcaagaaaggtttctcggtaatccacgagtaatacatcacggctgtcgctcgatgcggatctttctccgacagaaccgccaataaactatccatggagcaagaaccctccgtataaaaatccactttcccctcagggaaagaagtttccatatgtttctccatctcatcccgaagccatgtggaaacataacgtctgtcggatatgaaaatcagacgtctcaaacccgggattaattccttaaccaagtcgatcgaacctttaacataataagggataaccaatcccgtagcgttataccccttaaccgcctcttgtaaaggaatcaccctatcagaggaatgcctctgattaaaatagcattcatcttctgccatttcacccgtttccgaacagaccagagtgggaatatccccccatttctcccggatcttatcccgcataaaagcccatccatttacgcctaagtagataattccatccggcttcttcttgttagcttcaaagaagacctcttgtttctcttttaatttctctggcgtatcaaccaacatcacgcttatatgatctatccggagagtgtactcctccggggtagcgaacttcgagatcatgtttaataaattgccagaccagcgttcgccatccacatatgaatttattaccaatacatacgattcatccttgaccggatatgaagaactcccataagccggagtcggcataccggctatcaagcataaaatcaatccaaaataaagtattattgcctttaaatttataatatttcgtatcattccctacattcctctattgcagttgtaaagacaaagatattccttaattatcaactaatcttatcaaactcgtttttttatcaagttttggtgtcaaattcacgtttcttacaaactaaaggcttttttaatcgggattattcggttatttaccgatactcgtatagaaatcagcggtatttacttgtgtatagaatgacgaacccgtacatttgataaaaaacaaaaaaatggaacttatggatatgaaagattatgacatcgattttaaagagaagaggacaaacgggtatctgatcgctaccttatttatcattgtcggtatattatttttactgcggaatctaggaatgatagatccatctttatttgacttgcttgtatcttggccgatgctgcttgtcgtgtcgggcatctttatgattttccaccgtaatccggtaggaggtatgctcctcgtgggcgtgggagtctatttccttttcccgcagttaaattggatcacgaacgatttcttacgtatatattggccgttaggattaatcctgttaggattggtcatcatgctgaagcggaaagattctatccgcacgaaaaagcataaacgtccttttaaccatccccctttcgggcacagaaagcctaacgatgagatcaactacgagacagataacggtttcgtatcggttgacaccactttcaactcggtaaggcacatcgtactggaccccgtattcaagggggcggacatagacgtatctttcggcaacgtgatcctcgatcttaaaaaaacaacattagaggctgatgaaaccatcataaacatagatagctccttcagcggcgtagtaatatacgttcctaaaggatggctggttcgtctaaaggttgattccttcttggctggatgccaagacatgagggacctgacagaaacaaccgacatgacgcacacgttatatatatgtggagacttgtcgttcagcggccttgaactaagagactaaactcatcatgcaagaacatcctattacaacatccatattacataaagggcagggaagcctattactacttttagccatagcgatccaatgcgcattattaactctttatggcgatcttccgttgagcatcactttggtcgatagcctactttccatcgcattgttcgccgtagcgggatattatctttggtatgtacaatgtacgttacatatcatgcaagcacgagtggctttcgccgtactcgtacaaatcgcttgcatagccggatgctcgatcttgctacaaatattcggattggaagattgggaggaattctcgatcacgattccttttcgattcctgttcggcctaatggcatggatcattctatcccaatggtatgccagccgggaaagaaagagtgaggcggaacctatcgggagacaaatggaggaaaagacggcacctcccccgactaccgttccggaggagattctagatcgtatatccgtaaaagacgggacacgtattcatatcatcccgataaaagagatattctatttgcaagcatgtggcgactatgtgaccttattcaccacttccggtcagcacgtaaaggagcaaaccatgaagtatttcgagcgaagccttccttctccggagttcgttcgtatacatcgctcttatatcgttaatacggaacagatattgcgagtagaactattcggaaaagaaacctatcaagtacgattaaaggatggaacctatcttcgtgccagtagcgctggctataagctactcaaagaacgtctttccctttagcagtcctataaaagggacctaatcatcgttaaaattagaagattttgattgtaatatatagagttttgtgttgtgtaacactttttggcaagcattgatatgttacttaacatatattagttgcaaaagacttgacaaatggtcttgacgaacgtatctttgcatcgtggttttttcataatagtattagatttaaggttaacaaagtttggttagggcttgtcgtgagacaggctttaattgtttatagaggtttgcttccctagatttacatataactataaaaaaacggccacccctaaaaagaggcggccgtaattattcttaatgaaagaacctactctttgacaatccttgtaacttccaaatcaaagatcaaagtcgtataaggctttattatgacacttcccgaagcactccttccagccgaaccgtatcccatctgttgaggaatccaaatctcccaacgatctcctgggtgcatattctgtaacgctgtagcaaaaccatctaccatctcagaaacagtaagctcggcaggggcacctgcctcaaacgatttatcatcaaaaaccgttccatcaataaacgtccctttataataacattccaccttgctcgtataataaatcggctccttactctctcctgtcttcaagaccttgtaaaggataaatccggcattactttgagaactcaattgctcgaaacccggaaccagcatctgggcttgaaaagcctcctcattctggaccttccaaacctcatccacctctagtgcctcatcatcatccccacaagaggtgatcatgagcacgcaaaacaacatcaacgcgatatgccagtacttcttcattcgtttactctattacctttttcaataaattcttcatgctcaccttctccgtgataatatcgtgaagcttatcgatgcttacgcgctcttgctccatcgtgtcacggaaacggatcgttacgcaattatccttcaaggtgtcatggtctaccgtaatacaatacggggtaccgatcgcatcttgacggcgataacgcttaccaatagaatccttctcgtcgtattggcaacggaagtcgaaacgcaacatatttataatctcctcagctttctcgggcaggccatctttcttcaccaatggcaatacggccaacttgatcggagccaaggctgcgggcaacttcaataccacacggctctcgccattcgccaacgtctcctcgcagtaagaacccgccatgatgctcaagaacacacggtctacaccgatcgaggtctcgattacatacggagtgtaactctggttcaactccggatcgaaatattggatctttttaccggaaaacttctcatgctgactcaagtcgaaattcgtacggctatgtataccctccacttccttgaatccgaacggcatctcgaactcgatatccgtagcggcgttagcgtagtgagccaacttctcatgatcgtgataacgatacttctgatctcccaagccaagagcttgatgccattttaagcgagtagacttccatttcttgaaccactcgatctcctcacccggacgaacgaagaattgcatctccatttgctcgaactcgcgcatacggaagataaactgacgagccacgatctcattacggaacgccttaccgatctgggcgataccgaacgggatcttcatacggccagtcttctgcacattcaagaagttcacgaaaataccttgagccgtctccggacgaagataaatcttagtcgctccatcagcggtagaacccatatccgtagagaacattaagttaaactggcgaacctccgtccagttacgagttccggaaatcgggcaaacgatctcgcaatccaagatcaattggcgaagatcctcgaagttagactcgttcatcgccttactataacgctcatgaatctcattccatttcgcttgatgctccaatacacgaggattcgtctcacggaatttagcctcatcgaaagcgtcaccgaatttctttgcggctttcgccacttccttatttattttctcctcgatcttgcccaaatggtcctcgatcaaaacgtccgcacggtaacgtttcttcgagtccttgttatcgatcaacggatcattaaaagcgtcaacatggccggaagctttccagatagtagggtgcataaaaatagcggaatcaatacccactacattctcatgcagcaaagtcatgctatcccaccaatatttctttatattattctttaactcaacaccatactggccataatcgtataccgctcccaaaccgtcataaatctctgaggagggaaatacgaaaccatactccttacagtgtgaaactaatttcttaaatacatcttcttgtgccataatctaataatttgccaattttgttaatatgccaatgtgccaatgataagtccatcggagacccgcctgagtgacacattagcacatggtctcctttatgcggctacaaagtaaatgattttttccgtaactatagaaagttttgtatatttacgacgtaaatcgttagtgtttgcgcaaacagtataatttaaacaagataataccatgaaatcagaagaaatctcacgccgctcgttccttaagcgagcgctagccttatcggcagtatcagccatcccgtcgttctggacacccgcccacggacgtgttctacctacttccccgctaatcagcgctaatgaccgggtaaatatagcgttcatcggcatcggacaacgagggggcgagatcgccaaggaattgtataacacaggtctgtgtaacgtggtagctctctgcgacgtggacatgggagcccctcacacgcaagagattatcaacatgttcccgaaagcggcccgttttcaggacttccgcacgatgttcgaccggatggcggacaagatcgatgccgtcagcgtaggcgtgccggatcattcccacttcccgatcacgatcgaggcgatggcgcacggcaaacatgtatatgtagagaaaccgatggcccgcacgttccaagaaatagagatcatgatgcgtggagcgaagaaatacggcgttgtcacccaaatgggtaaccaaggacattccgaggcgaactatttccaattcaaggcatggaaagaggccggtattatcaaggatgttaccgccattaccgcccatatgaataatccgcgtcgctggcacggatggaacccgaatattaggcatatgcctatgggagaaccggttcccgagacgatggattgggacacatggatcggcgtagcccaatatcatgattacaaccatgactaccatttgggacaatggcgttgttggtacgacttcggaatgggtgtcttaggagactggggagcgcatattttggatacggcacatgaattcctagatttaggattgcctacagaaataaatccgctttatttgaaagaccataacccgttcttcttcccgatgtcatccacccttctgtttaaattcccggaaagagggaatatgccggccgtggatatcacttggtacgatggactggacaatatccccgccgtaccggaaggttatggtgtctcggagctcgacccgaacatcccgaccgtagccggagggaagatacaaccggctaagttgaacccgggcaaggaaatctactcgaaagaattaaccttcaagggtggttctcatggaagtaccttatctatcatcccggatgagaaagcgaaagagatggaatcccgcttaccggaagtgccgaaaagcccgtctaaccatttcgcgaacttcctgctaagttgtatgggtaaggagaaaacccgctcaccgttctctatcgccggcccattaagtcaggtattctgtctcggcgtattaagccagcgcttgaaccgcaagctcgtcttcgatcgtgacacgaaacagatcacgaacgatccggaagcgaataagatgctgtgtggtttgccgcctcgcaaaggatgggaacaatattataccatttaattgtaaaatggagaattgaaagttatttgtttatcgctttgactttcaattctcccatataatttacaagcccatttgctacaatatctacaactatccctgcaatcatctggccttaggatatttagttcatggtggtagataaaaaacatctacaattatctggctctatctaccactatttactgctatttaccacttttccttcacctaacacaacgatcctctaccctcaccatatagcattatccaatctcctttcaacatatataaaatattagcatctagttatttgtagtttttcagcctaaaaaacaaaagtttttccatatgaaaacaaaagtttaataagcggaaaacttttgtttctctatagggaaactaaagtttcctcagtatgaaacttttgttacctctaagagaaacccacttttgcttttaatcccgacgctacgctctgcattttttgttatatttatggcaaatatagaaaaccataagaactaaaagaattttcaaattaccgaaggaaaagtacaaggagtgagaacaactacggaaggggtcttattgtataagggtatttcatgaagaacggaaatccgaacgaacaaggattggacgaataggccccctatacgaaggaaaaaacattcgtgatgacattccatatcgaataaagtcatcacgaacgccttcaaatatactcataggactccgagaaactcgactgggagctagaagaagctaattcttcagagactaattgaagcagattgccattctgatcataggacttcgtgatccgacgaagctctatggattctttttctgttggaaggtcggcataaaccatgatctccatgttcaatccgttctcattacggtactcgctatatcggagaacctcggacgtttcgggatcacgaatcgtttcttttgtcaacaaccctgtctcatcgtactcatagtccgtataagtaagcttccggccgagttcgtcgtactcaactttccgttccagaagattattcttataagaaaagactgtcaccttgctcttgccaataaccggatattcagtaatctcctttattttccgaccttgctcatcatacttataatgaagcgtagacaaattatgatacgtctgatctaggtttctgttgaagtaaacttctttagacaaaaaaccccactcgtcataaacatattcaacgtagccaatcaagtatccttctccatcctccgtattcaatggatgtaataccttggagatacgtcccgactcatcgtacacatattccttcgccagactctgaggagaggaaatacccgcaccgtaccaaactcgtgccaatttagctccctccggataaacaacactaggacaaatcaccggcttagcctcatcttgaaatgagtcctcgctacaccccagagtgcccagcaagacaaaaagcaggatgatcccacctatcggattgatgattctcataatatcttatttatttaagtttctataagttatagatgatcaaacaatctcaaaagctgcgtatctattaaaaaaagacaccgaatattcgtcagattcgtatcctatgagtgatttgccgttaaagcttgaacttatacccaaccgtcagactcatcgtattgtaattggcaccgacacttcttacctcatacagagagaaattatcgccatcgatcttatagttaccgccctcatcacctagagagagatcataccccagattcatcacccagttattcacctctataccaaaagaagttgtcaatccccaatcaaaagaattcacgtctcgaaatggatgatcggcgttttcagcctcatcatatcccgaatggccataaccataactataccctaggccagtagatttgacatatttaccaagcgcctgcggctccttcgaataccccatcgtaaacgaagatccccaattcgtatcattcttgacagatacaccggcatacataccgaccgctaaatgcatacgtacctctttcgacactttccatgagaaatcagccatcacgggcaattgcaaaaaatgttgcgtgataccaccggtcatcatctctttcaagacatacgtggcagactccgtcgttctcggataatctcccaacgaataccctctattcgcataatatagaccggatttcaatccaatccatcccggttcaaactggtaagatacaccaacgcctaccttaacccccgcacgccagctagagcccattccaacacgattaaccgcagcaaatccaccctccggagtaatcccccagcgtgattgagcgctcaccatcaagccgctcaaagcgcataacacaaataaaatcagcttcttcatatcatattcttttatatgtaaatatcaattgttattgataagacaaaagattctgaaaaacccctaccacctaaatatttattttataaaatctctttatttaacgcaaactcactctcgtaaaagcctcattcttataaaaactgccgaatatttgctatatttacaccctgttagcaatttggcgtaatagcgttgtgtagaaagaactggattttatgagaccggaagataaagaagacgattatatcgaggataaggaaaacgaggaaattgaggatataaatagtgatacccaagataacgagactacggaggaagaggcgaatacccattccgactataaagtcccggggaaaggggatacacgtgtcacgacctatcatttgtctgggatgtaccaaaactggttcctagactacgcttcttatgtgatcttggaacgggccgttccgcatatcaacgatggactgaaacccgtacaacgacgtatcctgcactccatgagaaggttggatgacgggcggtataacaaggttgcgaatatcgtaggtcatacgatgcagttccaccctcacggagacgcctctatcggagatgccttggtgcaattgggacaaaaggatctattgatcgattgccaaggaaactggggtaatatcctgacgggagacggagccgccgctcctcgttatatagaggctcgcctttccaagtttgccttggagaccgtattcaatcccaagacaaccctttggcagctttcttacgacgggcgtaataaggaaccggttaccttaccggtaaaattccctttattgctggcacagggcgtggaaggtatcgccgtaggcctgtcttccaagatactccctcataatttcaatgagttattagatgcttccatcgcctatctacggggagaggaattcgcgttatacccggatttccagacaggaggctctatcgacatagccaaatataatgatggagaacggggtggatcggtgaaagtccgtgcgaaaatcggcaagctcgataataagacattggtgatctcggagatcccgtatggaaaaacaacctctaccgtgatcgagtccatcctaaaagcgaacgataaaggaaagatcaagatcaagaaggtagacgataataccgccaaggatgtagagatcttggtgcatctcgctccgggggtttcttcagacaagaccatcgatgccttatacgcctttacggattgtgagatcagtatctccccgaactgctgcgtgatcaaggaggacaagccgcatttccttacggtcagcgatgtgctccgccactctacggatcgtacgttggagcttttacgggaagagctcaagatccagaaacaagagcaagaggaggccctgttcttcgcctcccttgaaaagatatttatcgaggagcgcatctataaagatccggaattcgagaacgccaagaacatggacgaggcgatatcccatatcgaccttcgtttagagccgttcaagccccgatttatccgtgaggttacccgggacgatatcctgaaactcatggagatcaagatgggacgtatcttaaagttcaactccgacaagagtaacgagttcatcgcccagaccttggaacaaatcgccaagatcaacgataagctggaacatatcgtcgactataccatcgattggtttaccatgctgaaagagaaatacggcaaggcttacccccgccataccgtgatacgcaatttcgacacgatcgaggcgaccaaggtcgtagaggcgaacgagaaattgtatatcaaccgtcaagaaggtttcatcggcatgggactgaaaaaggacgagttcatatgtaactgctcggatatagacgatgtcattatcttctatcgcaacggtacttataagatcgtcaaggtagcggataagatctttatcggtaaggatattctatatgtcaacgtatttaagcgtaacgacaaccggacgatttacaacgtcatataccgggacggtaagttcggatataattacatcaaacgcttcgctgtcacgggcgctacacgcgatcgggaatacgacctgaccaaaggtacggaaaactcccgtgtcctttacttcagtgcaaacccgaacggagaggcggagaccgtcaaggtaatcctgaaacccaaaccccggcagaaactactcgtcttcgaaaagaacttcagcgagatagccattaagggacggggttctcaaggtaatatcctgacgaaagcggaagtgcacaagatcagcctcaagcagaaaggctcttccaccttgggaggccgggaagtatggttcgactgggacgtactccggttaaattacgatggacggggagaagagctaggcgagttccatagcaacgatcagatattggtgatcctgccgaacggcgatttctacgtcacgaattttgaccttagcaatcactacgagtccaatatcatggtcatcgagaaataccagccgagcaagatatggactgccgtattatacgacgcggatcagaaatattattatatcaaacgattcctgctggaggtaaacacccggaagcagaatttcctaggagagaatcctaagaaccgcttgatgttgcttacggatgaggtctatcctcgtatcgaggtgatcttcggaggccacgacgccttccgggaagctctcatcctcgatgccgacgaatttatcgcggtgaaaggcttcaaagccaaaggtaaacgaatctctacatttgaggtcgagacaatcaatgagctggaaccgaatcgcttcgtcccttccgaaaacgcatcggaatcagacgataccgaaggcaatgaggagggaaacgacactgacgacgggcagagtaccacggatattatcgatgaaattacgggacagatgaaattgtttgacgaataacctatgaaagctatcacctgtttgattggtttgttcctgctgtttctcgcgtcaccggccaaggcccagtccgatggagacgagatcccttggtctatcaacagcgggaccatggtcggtataggaagctacaacctaatggacacctatttatctcccagcatggaagataagaaatatacaggccccggattacgggtaatgaatgaacggatgaagagggtccgactggcaaactatcgggtatccagacagcaaatcataagcgtcgatctggctagcacggataatgctgcctctaccgctacggatttcgcgggctttatcgattatacgttgggttactattatcatttgcccacggtattgccggatttaaagcttctggcgggtggtgccgtgcatggcatgagtggttttatatacaatacccgcaacggaaataacccggcctcagcgaaagcggatatcgatttgaacatctccgccatggcgatctataagttacgcgtcaaggaatatcccatgacgctacgctaccagttcacgatccccttcgctggtgttttattctccccccattacgggcaatcgtattacgagatcttcaacctagggaatgcctcgggagtggtgcaattcaattccttccataataaattcgccatgaagaactttttcacggtagatttcccggtttgtaattttacgatacgggcaggttacctaaacagctcttaccgtacagatgtcaatgggatacagtctcatataatctctcactcttttatgatcggcctcgtgaaagaattcatctctttcggaggaaaacgcctaaagaatactcagcggttcagaagcgcttattattaaaaggaaatcaaatgaaacgataccttatatatatatgtatatctctcggattcctgtttaccggatgtgagaaatcggacgaatacgtggcctccccacaggagaactttgaggcgctttggaaaatattggatgagaattactgcttcttcgaatacaaggacattaattggaacgaggttcacgaccgttataagacacagataagcgatacgatgaaccaatacgtcctatttgacgtattaggcgatatgctaaacgagctgaaagacgggcataccaatttgatatccaccttcaatatgtcccgctattgggattggtatctcgattatccggataatttcgactcggacatacaagagaattatctcggaaggaactactcgatcgccggaggacttaaatacacgacattgagtgacgggcagatcgggtatatttactacggtagcttttccagttcggccggcgaaagcggtttggatcacatattctatcaattcaaggattgcaaaggtttgatcttcgatattcgggataatggcggtggcatgttatcaaacgccgatcgcatcgcttcccgtttcttggaggaaaagatactgatcggctatatccaacataagacgggtaaagggcacgatgacttttccgaaccttatcccctttatctctcaccttccgagcgtatccgctggttacgccctgtcgtggtcttaacgaatcgtcattgctacagcgccgccaacgatttcgtgcagaaagtacgcatgatgccttatgtaacgacgatgggagatcgcaccggaggcggtagtggcttcccctttaactccgagttgcccaacggctggggtgtccgtttctccgcgtctcccatgctagatgtaaacaaacagcatacggaattcggtatcgatcctacatataaggtttctatgacccaagaagatatcgagaaaggtaaagatacgattatcgaggcggcgatcacccacctcttgtccgagaccgagaagaaataaggtttcgctaaaaaaacaacgcaaatatttgcaagtttataaaaaagcattacctttgcacacgattccaatgcggctgtggtgtaattggtagccacgtcagacttaggatctgatgcttcacggcgtgggggttcgagtcccttcagccgcacaaatccagaaatccttgtaagttcgcttacaaggattttttagtatggataaacctcctccatatatacaagcactgtgaagatcaaggattacaaacaacatccaaattgttaattttagaagattttgcgcatattctgtatagtttcaaattcaaaaacattttttacaccggactggcatgttgtttaacacaagttatactcaaaacccttgacaaaggggctttacaagcttatctttgcattgtggttttttcataatagtattagatttaaggttaacaaagtttggttagggcttgtcgtgagacaggctttaattatttataggggtttcattcgtttatagatgcttcccggcatcgattttatctttccatccaattccaactcaaagagcagagaagataattgatgtaccggaagattcaaggctacggacaattcattgatatgagattccttttgcgtctccaagaacgacaagatccgttcgctctcctcgttctccggaaacaataattgggtttggaccggtaacgcgtctgccttttgagcgacatcccaacgcatcgccatgattaaatcgtcagcgcaagtgatcaagcctcctttattctgccggattaagctattacatcccttagagttgatatccgttacccggcccggaaaggcatagacatcccggccatacgagaaagcgatatccgccgtgatcaaagagcctcctttctccgctgattcaataacgatcgtggcatccgccagaccggctacgatccggtttcgccggataaagttctgccgatctggattcgtcccgctaggaaagtcggtcaacaaacctccccgatccaacatttcgatcgccgtagagcgatgcacgggaggatagatacgatccaaaccatgcgccaatacgcccaccgtgggcaattggttcttcaacgcattccgatgggcacaaatatcgatgccatacgcgagtccgctaacgaccaatagatccgggaaactcacggacaaatcccgcaataaacgctcggtcacttcctgtccataagcggaggccctacgagtacccacaacgctgatgatatgggcggcgtttaaatccgcgttccccttgaaataaaataaaaccggagcgtccgggcattcccgcagacgttccggataattcatatctttcaagaaatagatagagataccgttcttttgggcaaaagccaattctttctctgcccgtaagagcacatccgcccgcttaatctcggcgataatcgaatcgccgatacccggtatcttctctagcgactggcgcttttccgtaaacacggcctccgcatctcccaacgcttccagaagatggcgggctaggatatctcccaccccattaatcatagtaaggccaatttggtaaatctgtttgtctgtcatttatgcttgttttgattctattcgctttagcatctcatcgaaatattctcctctggttaatttgccattctctacgacaacggattccacgactcctttagtagccagcgccccatcggattcccggtaaatatcttgctcgaacaccagtttcacccctttcttatatacattcaggcaagaagtataccgatcgccgctccgcaaggagttcttgaactggatatccacacgggccacaaaagcatcgatgcccttctcatgcatggcgccgaagttctcacccaacgactccagaaactcatgccgggtatgctccatataatgttggtaattggagttattcaccacgccttgcaaatcgcactcataatcgcgaaccttgtctgtcagtttaaaaatatattccttcattatcgtagttctttttcgatttgtactttctccattttataaagacgatcggacgggcggatcttctcggacatctttatcgagaagcgttcccctttcacggtctcctccaccggtttcaggtctacccggatctcatcgacggtctgcataacggctccggtcgtgggacctgttaccaagatctcatcgcctactctcaaggaaccggactccatctcaaactcggcgacaccgattccgctgaagtatttgataccccgtgccacgtacactttcttacgggtagcaccggagccatatttactgctccattcacccaatcgttgtcccagatagtagccatcccagaaaccgcgattaaagaccctgcgcagacgctcgtcccaaaccgctaccttctcctcatcgaaggtaccttcgcaataggccttgaccgcctctttataacattcggtcacgagacgcacatactccggcccgcgggcacgcccctccagcttgaacacacgtacgccggcatccatcatcttattcatgaaatgaatcgtcttcaagtccttcggcgacatgatatactgattctccacatccagctcgatctggctatccttgtcatgcaccgtataggcacgacgacaaatttgcatgcaagccccccggttggcggaagcgttcatctcatgcaaactcaaatagcatttaccggacacggccatgcacaaagccccgtgagcgaacatctctatgcggatcaattcccctttcggacctttgatctgctgcttcacgatctcctgataaatctcatacacctgctttaagttcaattcgcgagccaatacgaccacatcggcgaagcgggcgtaaaacttcaacgcctccacgttcgagatattcaactgcgtggataagtgcacctcttgcccgatgctattcgcgtaactcatagcggccacatcggcggcgataatggcggagacacccgcatccttagcggcgtctatgatctccctcatcaacggaagatcctcaccataaataaccgtattaaccgtgagataactcttgataccatgttccccgcaaatagcgacgatcttacgcaaatcctccgtcgtgaaattattcgacgagcgagaacgcatattcaatccctcgataccgaaataaatggagtcggcccctccttgtatagcagccatcaacgattcataggaaccgacaggcgccattatttcaaaatccttctctttcaaggttatatattttaatattacggtagcaaaggtacgaataatatttgagaagatttcttataagcacaaaccctccatcccatcatgaaagaatagttccagttggagaagcacaagatcctaaataaagcggggcaatccgagctctatcaatatatcataaatgatccggattattaaaaacgcctgttccatccaccgatcatcttacgagatgtaaaaattattccccaaaaagaagtacttttgtaatctctatttagttagcaaacagaaggtatgaagattggttcaatagatttaggggagcgtccggtattcttggcgcctatggaggacgtgacggatatctcgtttcgtttgatgtgcaaacgcttcggggcggacatggtatatacggagttcgtatcgagcgacgcgttgatccgcagtgtgaacaaaacacagcaaaaactaaatgtctccgatgatgaacgtccggtcgctatccagatttacggcaaggacgtagcctcgatggtagaggccgcacgtatttgcgaggaagctcgtccggatattttagatataaactttggttgccccgtaaagaaagtagcgggcaagggagccggggccggcatgctacgcaatatcccgttgatgctggaaatcacgaaagaagtagtgaaagccgtgaacatccccgtcaccgtgaaaacccgtttaggatgggatgccgacaaccgtgttatcgtggatctggccgagcaactacaggattgcggtatcgccgccctctccatccacggacgtacacgggcgcaaatgtacacgggcgaggcggattggaccttgatcggtgccgtaaaaaataaccctcgcatgcaaatccctatcatcgggaatggcgacgtgacttccgccgagatatgcaagcagcgtttcgaggactatggcgtagacgccgtaatgatcggtagggctagcataggccgcccttggatcttccgggaggtaaaacactatcttacgaccggggaattattgccacaagagcctttctcttggtatctggatatcctaaaaaaacaagtggagcaaagcgtggaacgattggacgagcgtaggggaatcttacatattcgccgtcatctggcagctactccactcttcaaaggtattaccgatttcaagcaaacacggatcgccatgctacgtgcggagactgttaacgaattattcgaaattatgaataacattcctaaaaagtacggaatttcagaataacaagcttgatatatatcaaattgaaacctatttgcgatatctttacaataaaatgttacaaatactattgacgcatattataaaaccccttatatttgcatcgagtttttttcatagtattttagatctaaggttaacaagtctttgcaaggggggaatcgtgagattgtttcattgaggagcaaaaaaagccgcatccatattgggactagcggcttttttgtttttccggactctatatcctaaatcaagaaacttatcgtatctttgtcaataggtcacattaaatatttggcactatgaaccagactatttatcccagtcggtatacagaatttcgagaagattcgcaaggacggagatacccataaactggcctcctccctcgaactgacctatgatgaaacacactccttgctgagaaagcgttacgacggctatcatttcgtagccaacgtaccgggtatctataaccctttcagcctgctgaatacctttaaatatatgcggcctgaagattattggttcgagaccgggacaccttcttatttagtagagttactcaagcacacccattacgacctctatgagctggcaaataccgagaccgatgccgatgtgctgaacagtatcgactcaacctctagcaatcctgtccctgtcatttaccaaagcggctaccttacgatcaaggattatgattctcgctttggtatctataaagtaggatttcccaatttagaggtagaagaaggctttgtcaaatacctgcttcttttctacaccagtgttagcgccccaaagactcctttcgaaatcaggcgttttgtccgggaggtggaataaaaaagcctatgttttcgcacacacgctatacattattcgaaataaacccttacatttgcgaaaaacataatactataccaccatgagtaagaaagtcataactttcggagagatcatgcttaggctggctactccggactatttacgcttttgccaagccaatcagttcaacgctacttttggcggaggggaagcgaatgtcgccgcctcactcgccaactatgccatagagactgagtttgtaacccgtttacccaaaaatgacatcgcccgtgcctgcgttatggaattacgcaaacagggtatcggaacatccaagatcatttacggaggggaacggttaggcatttattttctggagaccggagcggtcgctcgtgccagcaaggtggtatatgaccgggctcattcttccatcgccgagatccgaccggggatgatcgattgggacgaggtattcaaagatgcctcttggtttcactggacaggtatcacgccagccatatccgaaggtgccgccaacgtatgcttggaagcgatacaggcggcaaaccgattgggcatcacggtatcctgcgacctcaactaccggaaaaatctctggaaatacggtaagacagcccatgaggtcatgccggaactagtagccggatgcgatatcattctaggaaacgaggaagatgccgagaaggttttcggtatcaagcccgaaggtttcgacgccgccgccacggaaggtgaggtacacgccgtctctttccagtcggtatgtacccaattaatggctcacttcccacgtgcccggaaagttatcatcacgctaagaggctccatcaatgccaatcataacacatggggcggagtgctatacgccgacaaccgattgtacgaatcccgccggtacgacatcacccatatcgtcgatcgtgtaggtggaggcgattcttttatgggaggccttatttacggtttgctctcctaccccggtgacgaccagaaagccttggacttcgcagtagcggcttcttgcctaaagcacacaatttacggagacttcaaccaagtaaccgtagaggaagtagaaaaactcatgtccggcgacacctccggccgtgtctcccgctaattttcaattctcaactttcaatttttaattcccaatatggctcgattcaataaaatacaaacattacaggctatcatccaaaccggaatggtgcccgtctattataataaagaggtagagatcgcaaaacaagttgtaaaagcctgttacgagggaggcgtcagagccttcgagtttactaaccggggagatttcgcccacgaggtatttggcgagctggtaaaatacgccgccaaggaatgtccggaattagtattgggcgtaggttctatcgtagacccggccacagccgccttattcatacagctaggggcaaacttcgtagtcggtccgctgtttaacccggagatagcgaagatatgtaaccgtcgcctcatcccttatacgcccggctgcggttccgtatccgagatcggctttgcccaagaaacaggttgcgacctttgcaagatattccccgccggaaatgtaggaggtccctcatttgtcaagaacataaaggcacccatgccatggaccctaatcatggcgaccggtgccgtggagccgacagaggagaatctatccgcttggttcaaggccggcgtgacctgcgtaggaatgggatccaaactctttcccaaagaagcgatagcgggaaacgattggcaatccattaccgatttatgccgcgacgccttatctatcattcaaaagtatcgccaagtatgaaaagctttttagatcaagatttcttgctccagaccgacacggcccgtgagttatatcacgagcatgcggcgaagatgcccatcattgattaccattgccatctggatccccggcaaatagcggagaatcaccaattcgaggatcttacggagatatggctgggcggagaccattacaaatggcgggcgatgagagcgaacggtattcccgaggaatatatcaccggagataaatctccttacgagaaattccttaaatgggccgagacgatgccttacacgatgcgaaatccgctttatcattggacgcatctggagcttagccgtatattcggaatccataaagtcttgaatccggcttccgccaaggaaatctacacaacttgtacggataaactacgtacccccgagtatcgtgcgcaagccatcatgaaacggatgaacgtagagatcgtttgtacgaccgacgatcctatagattccttggaataccatcaaaaaatacgttcaaacggatgccacactcgtgtatatccggcatggcgaccggacaaggtactcgctatcgataatttcaaggcgcttaatgactatttgtccaagctggaggaggctgccgataagaccatcctcacctacaagcatttattggaggctttacaaaaacgacatgatttcttcgccgcccaagggtgccggttatcggaccacgggttggatactttctatgccgaaccttataccgagcaggagattgaggtgatcttcctcaaggctcgtatgggtaaatcgctcacggagcaggaagttcgcaaataccgttcggcattgctatacgaattggcggtgatggatgcccggagtggatgggtacaacaattccatatcggcgcaaatcggaataataacaaacggatgttcaagttattaggagcagacacaggtttcgacgctatcgatgatcagccggtagctgtttccatcaaccgctttttcagccgtttagatcaagaagggctgttagcgaaaacgatcgtttacaacctgaatccccgcgacaccgagttgatggtagccaatgcctacaatttcaacgacggcagtgtacccgggaagatgcaatatggagcggcttggtggttcctcgatcagatcaaaggcatggaagatcaattaaatgcgctttccagcctcggtcttttaagccgtttcgtcggtatgctgacagattcccgtagcttcctgtcatatccccgtcatgagtatttccgccggatcctttgtaatatgctaggcaatgagatagagaaaggcttattgcccgcctccgagttttccttcattggacagatggtggaggacatcagttacaacaacgctaaacgatactttgatttctgattactgcaacagctttgcaacattttattcacaaacacttcataagaccttccactatactcgcacatattacgcctacttttgcggcagatttagataaacactaaaatacgcaaacatgaaacaacggctttatgatttcatccctgtcaagcatctatgcgtagggatgtctttatgtggcatagtggcgggtacccaaaccgctcaagcttctcccgtctttgggcaatcatcgggcttagaacttccgagtcccagcatctaccaacaaagtacgaaacagatttccggtatcgtcaaagaccaggcggggattcctgtaattggcgcgaacgtgatcgtaaaagggacgacaaacggagtaatcaccgggctcgatggagatttcctactggaagttccggaaaacgctatcttagagatcagttatatcggttatatgacgcaaagtatcccgataaacgggaaaacgaccttcaacatcatcctagaagaagatacgcagaaattggatgaggtagtcgtactcggttatggagcggggcaacgcaaacaagatctctccgcttccgtgggcgtgctgaacaacacggaagacttggtggcccgtccggttacctctaccgaaagtatgttgcaagggcagttagcgggtgttaccgtacaagcgaacggtggagacccgacggctacaccctcgatcgtgattcgtggacagggctcacagaatggcgataacgtattatgggttgttgacggtgttcccggcgcacccatcgcctctatgaatgatatcgagacgattgtcgtcttaaaagatgctgcctctgccgctatctatggagcgcaatccggagccggcggtgttatcttggtaaccaccaagaaggcgaaagagggcaagacctcgttgagctatgacgcgactttcggtgttcgtaaagctagcaacgtaatcgagccgttaaatgcggaagagcaactcgagatgcgaaaactgtcttacgcaaacgcagggcttacattgccgaccggttgggatttgaccaagaacccatgggtaggtaccacacgtaccaactggatggacgagatcttccgcaccgctttctaccaacgccataacgtagccttgaatgttggttccgagaatgcctccaaccgtgtttcatttgcttacgataacgatgaaggtgtattgatcaatactttcaacaagaacctttcacttcgttacaacggtaaattcaaactgaacaaatgggtgactatcaccgaagacgtggtttggaaaaacaacgaaagccgttcaaaagataccgacagtggttatacgggagttgtcgcggcggctatgtatatgcctgccagcgctacggtttacaatccgctggatggtacttacggtggaacaacgaccgaagacccggattacatcgccaaatatggctccaacttcgcggatatccacggagacgctgtcaatccggttcgcttgctggaagcggaaaaccgctatgaccgaaccagcgacatctggagtacgaccagtctggaactagctaatatcgttaccggcttgaagttcacgagccgtttcacttacaacctgaagaataatctatataagaacttcagcccgatccgtgacgaggtgggaaaaccctccttgacaaataatctggatgaaacgacttaccgtgcagacgcatggaaaacggaaaacacattgacctacgacaatacgtttaatgacatgcacaccgtgggtgtcttactatccactacggccgatcattacagcaagcgaggattagaggttaatggaaaagatttatctgacgaatccgcttatttacaatatctatcctatgcgaattccgtttccgcaaccgattatttgaccggtcctgacgcaaacgtatccttgatcgcccgtctggcttattccttcaacgatcgttacttcgttacagcctcttggcgtcgtgattacgcaggccgtctacctaaagataataactatggcgactttcctgccgtaacagccggatggaaaatctctaatgaatctttcttcccgaagagcgagacactgaatttattgaagatccgtgcttcttggggacgtgtcggtaatctaggatctatcggttataattacaaatcagctttattaggtaagaattattggtcggagcaggcacagtacggcgtagaatcgaacaagatttggggaaacttcgtctataactctaccgcattaaatcccaacttaacatgggaaacttccgagcaatgggacttaggtctagatgtgaacatgttcgacaatcgcttgagcatggcattcgactatttcgacaaacgcacgttcaacttgatccagtcgcaaacgatgaactggccgggaacgatcggtatcgatgccatgttagtcaatcaaggtgaagtccgcaaccgaggttttgaggcgcaaatcaattggaaccaacaggtaaataaagattggtcgtacttcgtttccggaaacttctcttatctaaagaactgggtttctgatattggggtaaagaacgcagacggaaccccgggtgtctggacaggtatcaccaaggacaatgcctatttcgatggaagttatcgtaaccttccatatatgtatcaaacagccgaaggagaaccgctggcctctttctatctgatcaagactgacggcatttttcaaagcgacgcagaggcagccgcttatgtaaacaaagacggaaaacgaatccaaccggacgctgtagccggcgatttgaaattcgtcgatgccaatggtgatggagtcatcaatgatgaagaccgtcaatactgcggtagcgctacacctaaaactacattctcattctccggaggattcacttggaagaagctttccgtaagcgctatgttccaaggcgtaggtggagcacaagctttatatgtaggtaaatatatggccttaagtgatgtagaaggaaacttcaaccgctcaaaagagatcatgaacgcttggagtccgtcgaatacagggtcgaatattccacgcttatcgaaaaacgacccgaatagcaactttagcacaccgtctgattggtatctggagaatgcttcttacttgcgtttgaagaacttcaccgtatcctatgacttgagtgatgttatcaggaaatgcgctcacctgcaagaacgcaacagcatgatgtcggtttaccttagcggtgagaacctcttcacgatcacgaactactcaggaatggacccggaaaccggcggttgggatgccttgaagtatccggtttcacgcgtattctctgtcggagtcaaattgacatactaatcgggtgttttaaaagatattcatattaacaaaggatcaaaatgaaaagatatattacagtattagcattatccgcattggtttgtagttcttgtagcgacttcctcgacgttcagccggaaggaaacgcaactacaacctcctatttcttgaatgatcaacaggccattgatgccattgacggattatatgaaagattccatcaagagggttgttacggccgtgagttattctgggaacagggagccgcatgcgacattgtttggggacgtacgcgcggttataactctttggcgaccttagcctataccggtgatgaatctcctctaagagatgtattcagccgtatgtattctactatgtcccgtgcgaattggatcatccaagaattagtgaagaaagaaaagggaacgacgctgaccgccgtcgagaaacgcagcttgggcgaagcttacttcagtcgcggttgggcacattatctgatcgcttatcggtacggtacggataaacaaggagtgcctttcgtacgttacgaggacttccccgacgattacgacaactccataccgcctcagcaggctaccgttatggacaattataaactgatcatcgaagatatggacaaggcaatcgcctaccttccaaacttcgaatcctatgacgctgacaaccggggccgggcacatcaggctgctgccgtggcgttcaaagcgaaaacttatgcttactgggctacttgggatgctacccaatggaacaacgtcatcgagatggtcaatcaattagagaacaactacaatcgagatctagctcccacatttgcggaactattctcgtctgacttgaaagattattggaacgccgaatatctctggactattccgagtatcggtggcgcactaccgggcggtaccgaattcccgggtattatccttgagaacaaaggctggggcaaatataatggttgggggcagatgaagccctcttacgacatctacgaagaaatggcgaaagatggtaaaggtaatgaccgtttagtacgctcaatcttggaatacaaccaagagttcccgttcttcggcgagacacgcaagttctggtctacctccgatcttgaagctggtttcatgatcaataaatacatggacgcgttcaaatactcagaccctgtaggtgaaggagccgtgagtgctaacggagactggcctacggtccgtgtcaatttcccgatcatccgtttcgcagaaatgttattgttccgtgccgaggcatatttaatgacaggccaagccgataaagcaaccgcagatatcaaccgtatccgcctacgctccaacttggtaccgcttgccggcaccgccacgatgaaggatctatatcacgaacgccgttgtgaattggcttttgagtttacagaccatctattcgacttaaagcgttggaaccgttcttccaatgccgacataaagacattggccgataaagagttgaacgcacatccacgtatccgcagatatgaagaccgggcgaatccggaatccgcgttcacgattattggttacgaagattacaccaacaaaaacgcctatcaagcacatatgatggtattcccgtatccaagtgaagagattactaaatcgaatggtcaactgaagcagaacgagggatattaaccggctcctttaaaccgatcaaggaacgaataagattcaattacgggctgtctcagaaaatgaaacagcccgtgttattttctaccgggtaaaaacgcatatctcaaataggtagtttacctttgccaattgtataatatagtaaacaaaagatacaccatgagattaattcaaactctttcttcttgcttgtgtacagggataatagccttattcacggcctgtagccaagcaccacaatcccccatcgattccgtgaatccgtttatcggcacgggatttcacggacacacgtatcccggggccacggctccttacggagcggtccaactcagtccggacacccggaaagggaattgggacgcttgttctggttatcattacagcgattctaccttaatgggtttttcccatacccatttaagcggtacgggatgtatcgaccttggcgatatcctattccgtccgtcactccagacacctctagcgttctcgcactcggacgagaaggcttccccgggttactactcggtgaatctcagggaggcaggtgtattagcggaacttaccacgaccccgcatgtcgggatacaccgatatacctataaaaaagggatagagtctacgttggtggtcgatatggaccatttattggataacgaatatatatacgaaggctgggttaagcaaaccggggagaatgagcttaccggtatgcggcgtacccggggctgggtagacaatcagtatgtcttctttgtagcgcaattctcgcaacccttctcttccatggaacagccttccgaacggcaagccgtacttaccttcgatacgactaccggaaagcccatcgtctgcaaagtcggggtatcgatcgtaaatgaggagaacgcccgtctgaaccttgagcaagagacggattcctatggctttgatttcgacgccatccatcaagcgacacgctccaattgggaaaaagaactggacgttatcacggtagaaggaggcaccgaagccgagcgcacgaatttctatacggcgctataccatagcaagatcatcccgaatatagcgagcgacgtgaacggacaataccgccgtcacgacatgagcgtagcgacgatcccggcaggtcgccgccaattctccaccttttccacttgggacaccttccgggcctggcatccgatgatgactctgttggatactaccttggtgaatgatatggtacagtctctcttggatatgtacgacgccagcggcgagcttccgttatggcccttatcggcaggcgagaccgggaccatgatcggttatcactccacatcgattatagcggacgcttatttgaaaggtattcgcggatatgatgcggaacacgctctcgaagcgatgaaaatctcagcggagaagaataagaaaggagcggattattatataaaggaaggcttcatcccgacgaatatcaagaaagaatcggtttcctgcctattggaatttgcctacgatgattggtgtatcgcacaaatggcgaaagctttaggacatatggatgattatgagacgttcatcaagcgctcccagaattttatcaacgtattcgacggtagtacccggttcttccggggcaaacggcaggatgggaattgggagactcctttcgatccattcgccatcggacgttcctatacggaggctacggcctggcaatatcgtttctttaccccgcatgacgtatatggattgacccagttgtccggaggccgggaggcgttcatcgctgatctggatagcttatttatggttacctccgaggtagtcggcgatctggtagacgttacaggattggttggtcaatatgcgcatggcaacgagcctagccaccacatggcttacctatatagctatgtgggccagccctggaagacacaggaatggacccgtcgcttgctggacgagatgtaccagcccacgccggaaggtatcatcggcaatgaggattgcggccagatgtccgcttggtatatcttgagcagcctcggcttctactccgtatgtccgggtagcaaccagtttatcctaacgaccccgttgttcgataaggcgaacatgaagctgggcaatggcaagacattggtcattaccgccaaccagccggataagaacaagtatatcacgaaggttaccttaaacggcgaggagatatcgcattgctacatcacctacgaccagttgatgcaaggaggcacactggactttacgctctcggcgacaccggacaagcgttggggaaccgctcccgagtacgctccctattcctatacggagcaacctaccgtctctatcccttacatagcgaatgatctggatttatttgaaggagagattacggcggaactaaaatccacgacacccgaggcggttatccattacacgcttgacggatcggaaccggatgagaacgctccggtatacagcgagccattcgtcttaaaagagaccacgattatcaaggccaaaggatataaaaagggattcgtacccagccgtacgtactcgatccaagcgacaaaagccgtattacgccccgcgttatccatacagcctacgaagcatggggtagcttatacctattacgaaggagagttccaatgggtagccgatctgcaaaaagcgaaggtagtcgagaccggaacaatacctgagccttctatcctgaacgctaaattgccggatcatttcggttatatcttcaccggatatatatacgcaccggaagacggtgtctatgagttcagtacccgctcggatgacggtagcgtcctctatatcggcaaagaaaaggtagtggacaatgatgcctcccacgccgccatcgacgcgacgggacgcatccccttacaaaaaggctaccaccccttcgccttgcattatttcgaggattacgagggtgagtacctaggctggagctggcgtacgccaagcatgtccaaactagacgcgatcccaacagagaacctttatataaattgataatattaaatactgaatcatatgagaagaacaactctatccgtgctatccgccttagccatcctgctatccggcatgatcgttccggaggccgcggcacaaagtcgccgagacaaagaacaaacgtatgtactagagaaaccttacgaggtcaagaaactagtcccccctaccggaaagaaaataaagaacgtgatcctaatgatcggcgacggtatgagccttatgcacatgtattccgcttggaccgccaaccggggcaagctctggctggacaactcccaatacaccggcctctcgaaaacctattgcgccaaccgcctcatcaccgactccggagccggaggtaccgcactggccaccggccataaaacgaactaccatatggtaggcgtagacccggaaggcaagcccttggaatctttgactaccttggcgaataagaaaggcctgtcaagcggcatcgccgttacctgtcgcctatgggatgctacgcccgccgacttctgctgccacaatacggatcgtgacgccgaggccgagatcgtagcggattacgtgaactgtggcgtcgattacgtattcggcggcggctccaagctattcgagaaccgtgcggacggtcgcgatttgttcaaggaattaagggagaaaggttaccagactccccgtagctgggaggaactggcgaagatccaaaaaggcaaggtattctgcgttaccgataccgtagacaccccgcttcccgccgagcgaggcgatctcttggctcgtgcctcgatgaaagcgatcgatctgctgggacaaaacccggaaggtttcttcctgatggtagagggctcccaattggatgattacggacatttcaacgatatcgacctgttgatgcaagagacacatgatttcgaccgtacgatcggacgtatcttcgaatgggccgcccaagacggtgagacattggtcgtcgtaaccgccgatcacgagaccggtggccttaccttggtggacggggatctgaacgagggccgtatcgtttgtaaattctccaccggagggcatagcggcgtaatggtccccgtttatgctttcggcccgggcgccgagaacttcacgggtatcttcgagaatacggatatcttctggaagatcaaaaagctcctgaatctataatcaaacagtattcatccgatggagagtataacagggctatcccgctagtcaagtaccgcagtactttggctgagaggacagcagtacttgactagcagtactacggtacccgaccgggaggactgtgttcaccgactgaggcgcgccttctccctctctcccccaataaatatcataaagaatgacaacaagacgaaacttcttaaagcaatcccttcttgcggcaggcgcggcctccgttcccgccgggaaccttttagcgcaagagaaaatggaagagaaacgccccaaatacaatcttccttacaagaacacctacctgaaggaacccttcgtgaccgagaacgagttccggacggcgaaaccggagaccatcacgcccggaaccttcgaggaggccaagcaaatcctcccggacccgacttggagcggacacgagaaggaaatcgagatgtactggaaggcttggcaaatcggcatcggcaacatcaaggccccggaaccggattccggtttcgtatgcagttacctcgatgtcgcctacaacggcaatatcttcatgtgggactccgccttcatgatgatgttcgcccgtttcggtacccgcttcttccccttccaacgtacgttagataatttctacgccaaacaacatccggacggtttcatctgccgggagatcaaggcggacggagcggactgtttcgagcgttacgatccgaccagcaccggaccgaatatcctcccttggagcgagatcgtctattataagcagttcggcgatatagaccgcctacacaagatattccccgccctttgcgcttattataaatggttgaagctaaaccatacgtggcgcaacggtacgtattggaccagcggctggggtaccggcatggacaacatgccccgggtggaaccgaaatacaatccgatatacagccacggccatatgatctggctggacgtttgcttgcaacaatacttcaccgccgggcatctgcttgagatgggtttctatctggagcgttggcaggagatcgaggagttcgaggacgagcagaagatgctaaagaagtatatcaacgagaacctatgggacgagaaggagcatttccttttcgatcaatacgccgacggaagcctttcctccaccaagggaatctacgcgtactgggccttattgaccgatgtcctgtccaaggaacgcatggatgctttcgtggccgagctggataacaaggagacattcaaccgcctgcaccgcgtcccttcccttgccgccaaccatcctaaatacaaggataacggccgctactggcagggtggcgtatggccgggagcgaactatatggtgattaccggcctattgcaacaaggctatcgtaaattggcttacgagatcgcacgcaaccattacgataacgtcctaaaggtgtataagaataccggtacgttctgggaatactacgctccggaacatgaggagccgggcttcatggctcgcccgaatttcgtgggctggggcggactggcaccgatctccggcttgatcgagcaaatcttcggcatccgctccaatgtgtacgagaagaaattgaccgtagacgtgaacttgacggaggcttatggtatcgaccgttatcctttcggcctcgacggtctggtagcgatcaaagtcaagtcccgttcttccgctacccaagagccgcaggtagaaattaccagcgacgtccccttggaactaaccgtcctttggggcgacaaacagaagacggctaacgtaaaacccggcacgcaaaccgtataaaacagtaaatccatcaaacatccagttgtagagacggggcacgccccgtctctacaactagactcaaaaaacaattagtatatgaaacagattctatccttatttatcacctccctcgccctctgtacggcttgctcctccccgaagggatcggacacagttcaagtggcggagacaaccacggagcagacgattcagaaagcctcctccgcaattcattacaacgccttctcgcacaatgattactggcgggagagacctctgctggacgccttgtccttccgcttcaactgcgtggaggccgatctgtggctgatcgatgacgagctatacgtttcccatgaccgcccggaacccaatccggcaattaccttcgagaacctatacctcaagccgctcgtggcccgcatacaagcgaatggaggtaaggtctatcccggtagcgatcgtcctttctacctgatggtggattgcaaggcacaaggcgaagagatgtacaagctattaaagaaacagatggaaccttacaaggaatatttctgttccgtcgataacggcgaatataaagaaggtgccgtcctcttcttcctttccggcgaccgtccgaagaacagcctgccgaaagagaacagccgcttcaccttcctcgacggacaaataaaggatctgggacagggcatccctgcttccctcgctccggtcataagcgataattactccgatttcttcacatggaaaggcgaaggtgagatgcccgccgaccaactacagaagatgcgtgagatcatccggaaagtccacgatgagggaaaactattccgttggtggggcgccccggataccgagcagttcaaacgcttcttcatcaaagaaggcgtagacttggtaggtgccgatgacctgaatgggttatacaacgtattgaacgagcgttaaacgagaaaattacaataggcattataaggttgttacaatgggcattctagcatctttacaacaggcatcgtaacagccttataatgcccatcatagttttaacatatcacaaccgcttttattccaaccaaggctgcggattcagcttcgtcttttccttccacaattggaaatggaggatcgtggaattaccgtcctccggatccgaatagatccttccgatcgcttgacgggtagagacccggtcgcccgcttttacatatacctgactcaaattgctataaaccgtcaagtagttaccatgacgaacgattacggaattattataccccggcaccacgaacacacgcgtcacctccccattgaataccgcacgggcatccgccccgggtgaggtctggatatcgataccactattactggtacgaacatatttcaactcctgatgctgttgctcgccgaatgtagcgacgatcgtatgtcttccggccaccggatacggcaaacgtccccggttattggcgaagttatcggacaattgcttctccgcctttgtcatcgcatagccccctttcgtatccgccacacgttcctcacggatcggctcttttttactttccggtacgggtttacccttagcggcagcttgttcacgagcacgacgctcacgttccgcacgttcacgggcggctttcgcctcggcctcggcacgggcgatctcctcggcgatctgcttctctatctgtcggtttaaagcctcggcttgacgacgcttcttttggagatccgccttcaaatccttttgtctcttattcaatagctggacttcctctttctgagaagcttcctcactttctagcttcttactctcttcttgacgagttcctaaaagggcacgtttctcggcacgggtcttctccatctcagcttgcttacggctgatctcggcctgcttttcaacgatgtcattcgcttgccgcttctgccaatccgcatattcccgcaaataccgcatacgccgcatggattgagagaaactctcggcggataggataaacaacaatttatcttgcgagctatggcgtttataaagccctcgcatcgatttaccgtaattcgtctgcttatcgcccagttcccgttttaaggtgcgcaactggccttggatattcaagatatctttctcgatctcatccagctcttgattcaataaactgatgactttcttacgggaaagaatttgtttggagagtagattcaaacggttcagggaagttttagcagtctgggccgtctcttgcaataatttattcgtctcctcgatatcggccaacgcctccttgcgctgctgctccaactgacggacagcggcggatttctgaccgtaaaccacggtagataaagacaatgccaatagaacgatccagacgtgcctcatgatagattattgattcagattcgtaatcgttttcaatacttgcgcaaaggtaatacgcttatatttagaaggaaccgaaaaatccaacttgagcggctcgtccagttggatacgggagtaatggatcttcaccccaccctcgggattcccgttcttcaacacctgcacatccatcaacatcgggaacggctgccgatccaccaagcgaaaatcctcgtacagccattgcaaggcataacgatcggaaggatccgctacataggtagagagaagtttctcctcgccatccgccttaaaggtatagaaaagccccatggcatccttggtcttgatctcggctaccgggccttcttgattcagcttaaaacgattataatgcttacgggaaacgccctgctcccccgggataaacagatgattcgtgaaaagagcctgcaaattgtagaagttgaactcgatcggagtctgcccttgcaaattggaataattctcgatcatatagcgtttattcatgcggtctaccaccttgatcgtatcccggctcaactcgatacggaagatctcgatcccgagaaaaggttgtaccgacagttggaaagcactatccttgaccatcttcatatccacccgagagctcatttgcttaccagggatatccagatccacgttcaaccgggccgtcaaggtacggaactggaaggattgatcctccaccgactggaagaactcattatgagccttcacgctagcggattccaccgtcccgactttcttggacgatttacagcctgtcaacatcgaaagtaaaagacctccacataacaggaaggtcaagaaatagtctcttttcatttcgcgttctcgtcttctatatattgttgctcggcgatcttacggttcaagatctcggaatccttccccatctctttcgcctttttccattgctccaccgctttttccttatcaccgttcatgaaaaggatgtccccataatgatccacgagttcggcgctctttgtcttatctttctccaaagcgctctcgatatagattttcgccaaggtatagtttccttgtacgaagaagatccaagcgtaggtatccagatacgtggcgttgtccggttccagcttgatacattgggcgctcatacgttccgcctttttcaagtctttcttctccaaagaaaggaagtaactgtagttgttcagtacgaccacgttcttgtcattatacttcaacgcctcatcgtacgctttatacgcttgatccaattgccccatctggtaataaatatcaccgatctgaccgtagaaatccgatttcagcggcaggttctccttcggaatgatattcaagcccgcataataggtattcaaggcttcttgatatttctgttgttggtagtaagcgatacccagatagaagtaatattccggcgactcggggaaaagctccatacaagccgtacagatacggatgacctccgggatatcctcccctttcaaagccagattcagcaattgctgccaagccccggcgttacccggttccatctctgttaccaactggaactggaatttcgcctcctctgtctttccttgggccatcaagagaccgccatacatcagttttaagtcgatatcctccggatgttgctccaaaagagtttggaataaatggttcgcattctcagttccttgcttcgtttgttgcagtttcaagatataccgggaaaggatgttcactttcgtctccacgtccagcttctcgtttaccaaagcgctgcggatttgttgctcggcggcctccttatcccctttcgcctcgtagtaattggccatagagacgatataataagggtcggtcggatcaatctcattcgctttttgatagcaagccaaagccttgtccatctccccgttttccaaatgaagatcgcccaatacgatctggtaacgggcctccataggatatttagccgctagcttctcgatctccttgaaagcctcttccggtttctccaactggacgtacagtttgtatttctgcatggagatcgcctcgttcatacccataaccgactccaacgcatcataagcctcgatcgccttcccgatctcgccggcttgcgtcaaggcatcggccagataataattcagctcctccttctccggataatcacgaaccaattcctcgtactcctcggcggcttcgccatacatgcccagattccgggtgatagacgccaatgccattttatacgtgaaattatccttgctgttggccacggctcttttcaacatctcgaccgctttctccggacggttcaactgtacataaaaagaagaaagctcatacaagaccggagccgccgtagagtcaatctccaagcaatggttgaaggcatcataagcggcgtcgaatttcccggcgttcttcaagttcaagccctcataaaagaagtaatcgaatttacgttgatccttctccgtttctgtagcaccagccgggagcacagcgaccaacgagaggaaagagatgagatatatcagttgcttaaacatcctattattcttgttaaccttattattcttattcttttccggtatggccgaaccctccggctccccgctcggtatcatccaacgtctccacgggctcccaatccacatggctatgagcggctataaccatttggcagatacgctcaccatcattcaccgtaaaaggctccgaagatagattcacgagaataatgccgatctccccccgataatcggcgtcgatcgtacccggcgtattcagcagggttatcccatgctttaaagccagcccgctacgcggacgcatctgggcctcatagccttccggcagcgagatataaagtccggtcgggattaatttacgttccaacggtttcaacacaaccgattccgacaaattcgcccggatatccatcccggcagataaaggagtcgcataacccggcagcgggtgatgcgatttattgataattcttactttcatacttgcaaagataaacaaattgtcaatagtcaatcaattaacccaatccccgttctcttttattaactgaactaaacgttctacagcgtcttcctcggggatattcttgaggacacattccttacctttatacaggctgatttgtccacgtccggcacccacataaccatagtcggcatcggccatctcgccgggaccattcacgatacagcccatgataccgatcttcaatccttttagatgagaagtagcctccttgatacgggcgatcgttgtttgcaggtcgtacaaggtacgtccgcaactcggacaagagatatattccgtcttactgatacgggttcttgtagcctgcaagattccgaacatacagcgatccgagacaaccgcctcgcatccctcattgtgcagcatcaagccatccccgaaaccatccagcaaaagcgtaccgaaatcggcggcggatttcagttgcaacaactccacatccgtctcccggaaatcacgatgcaagacaaccggcacgtcacaacccgccatcagcaatttatgcatagccgcacgttgcgagccaaccccattccgatgatgtgtacttaataagaccaccacggtcttatccgctttcaagatctccaacatacgatccgtaagatccatatacgtcagacggataaacttaagcggacaatcgtaatcctttaactcctccgcctccgaggcgatgaagcaaggaaaagcattcggacgctctttccaaaaatgagcgtctaccaataaacggaaattatccggcaaattatccggatcttcctttcctatatatatatagtccggcaaggacaaataatcaaactcaaaatccccgctactacgatcggagatcacgactggcgagaaagtacctccgataccttccaccacacggcttatacgacggcttgtcgccaccgtatcgaaaccgggagccatcgaagcctcgataggacgatgattttcccgttccctaatataatccaccaatttacgcgctaccggcatttccgcctcggggtcctcactcaaggaaacccggatcgtatcaccgataccgtcacatagaagcgtaccgattccgacagcgctcttgatacgcccgtcctcaccgtcacccgcctccgttaccccaaggtgcaaggggtaatgcatattctcggcctccatcgtacgaaccaacaaccgcacggtccttaccatgacaacggtattggaagccttaatcgaaataaccacatctgggaaattctcctcccggcaaatgcgaagaaactccatacaactcgctaccatcccctcgggcgtatcaccataacggctcatgatacgatcggagagcgagccatgattcacaccgatacgaatagcggtgccatgtgccttacaaatattcaagaaagggacgaaccgctcacggatcctctcgatctcggcggcatattcctcatccgtatattcaagatggctgaatgtctttaccttatctacatagtttcccggattgatacgtaccttttccacctcaccggcggcggcatcagccgctctaggattaaaatggatatcagcgaccaaaggagtcgtatacccttgctcattcaattgtttacgaatctcgcccaagtttcgggcttcccgttccccctgtgccgtaaaacgcacatactcagctcccgcctcgatcatacggatcgcttgagctaccgccgcctccgtatccatcgttgatacattagccatggattgaatacggataggattctcacctcccataggtgtgtcaccgatttgggcaacggatgatttacggcggttgtaattaaagtaagccattgttcattgaaaattgagaattgaaaattgagaatgagtgttgagaactgaaaacctaaagagagactttctccttaattttcaattctcaactttcaactttcaattaattagttttgtatttaaaagaaaccttagccaactcctcgttagccttcacgattttcttcttcaaatcctccttataagcggatagcttctcctgaagttgctcgtcgccaacggcaagcatctgcaccgcaaggataccagcgttcaaagcgccattgatgccgacagtagccacagggattcccggaggcatctgtacgatcgccaacagagcatccataccgtccaacgtagagttaataggcacgccgatcacgggaactgtcgtcatggaagcgatcacaccgcaaagatgagcggccattccggcagcggcgatgataaccttgattccacgtcctttagctcctttggcgaaagcctccacctcagcgggagtacggtgtgcggatagagcatgcatctcgaacgggatctccatctcatccaagaacttagccgccttctccataacgggtagatccgaggtactacccatgataatacttacaacaggtgtcattcttatttagcgattaatttttgatagtcttcagcggataatagttcctccaactcagaagcgtccgtaagagaaatcttgattaaccaacctttaccataagcgtcttcattaaccaattcaggagcgtcttccaattcagcgtttacttccaaaacctctccgctaaccggcatgaaaagatcggaaacagtcttaacagcttcaatcgtaccgaacacctcttctttagcgacggtctccccctctgtcgtaatgtctacataaacgatctcacctagctcgccttgagcataatcagtaataccaacataagctacgtcaccttctacacgaatccactcatggtcttttgtgtactttaaatctgcaggaaaattcataattttagtgtttttattagatgaataaatagatataactcattaatgaggctacaaaggtacatataaatcccagacaaaaccccgcatatacctgcattggtgtatgcctttttaaaaagatacgcgaggtacctaataaaccggccacgatcaacacgactataaaagcccagtagggatttatcatatggatacgcgccactcccataataccgcccagtaacccgccgataccaatggcatgcgcgctaatcttccaagcgaaattgacgcataaggcgattaccaaggctacgcaagccccgatcagcatcgccaacaaccaaaacggcatcagcatcttatacaggaaaaagatacagaccaagatggaagtgataaaaatcagataaggaaccactcgttccttccggtcggaaagctctatatcgccggccgcgccatttttcaccaataagaaaatgaaaagtccgggaactatcgctgtcgaaataaaggtgcctccggcaatcagcagcttcacaggtaacgggtaaatggcgaggaatgtaaacatcaacgccaacacgatcccataggtcaccataagcaacggatggaacacgaaggatattatattcgagaatagcttcatacgcttttatatttcttttctcagacgagctaccggaatccccagttgctccctgtatttcgctaccgtacgccgggcgatgacatatcctttttctttcaggatcgtagccaactcctcatcggtcaacggttttcgtttgtcttcggcatctacatgctctttcataatctttttcacctcacgggtcgagatctcctcgccggtatcggtctgcatagactcggagaaaaagtatttcaacggataaataccgaaattcgtttgcacatatttactgttacttacccgggaaatagtggagatatcatatcccgcacgctccgctacgtctttcaagatcatgggatggagggtagcctcatcgcctgtcaggaaaaagtcccgttgtaaatagataatcgcctccatggtacgctgcaaggtctcattacgttgcttgatagcgtcgatgaaccactgggcggaatccaacttttgtttcacgaactgtacggcatcccgcctctcagcggtttggttcgccttattcgccgtataatcctgaaacatctcggcatactcccggttgatacgcatatccggtaccccccggttattcatgctcaagataagctctccattatgcgcttccaccacgaaatccgggatgatctggctcatcgccacttccatagaaccaccccaactacttccgggtttcggatttaacatagtaatctcgtgaatgaccttctttaacgtttcctcatcgatatcgagacctcgtaagatcttatcgtaatgtttgcgggtgaactcctcgaaatattcggtcaaaacacgaatcgccaaatttgtaaccggagtattctccttcttatccagctggatcaacagacattctttcaagtcacgggcacctaccccggcaggctcaaaatcttggatgatattcaagatagactcgatctccttctcatctacctcttgtccggcttggaagatcaaatcgtccgctatcgccgaaaggtcccgtctcaaataaccgtcatcatcgatatttccaatgatatactccgctattttcatttgcttatccggtaaatcccttaacccgagctgctgtaacagaaactcattcaaggattggcttacggagaaggggacatcctctttccgttccgcacgctcggtcatttcccgtagcttataatcaggtatatcgtcttccgttaaataatctcccaaagaaaggtcggtctcagtatcaacagaagggatctcttctcccccctcctcgctttcagttcgttcaaaatcatcaacaggctcttttccttcctccaaggctgggttatcttccagctcatgcttcacacgttcttccaactcgatcgcgggaagctccagaagccgtatcaactgtatctgctgaggggatagcttttgctgtaacttttgttgtaactgttgctttaacataatctaaatcattgcactgtaagggcaggacaatcacccgccctcttatttatcaacatgcaaatataagtttttagttttaacagtacagctattaaactataatagttctaaacaaggtgcatgacggaccctagcgactttaaaatccttccttcacgatccgtttgatcgggaggaagaatcgttcgatcaagcgtaattcttccgttacgatctccgcggaggcttgcgtctcgggcgagacgggcaggtcgataccgtaattggttctcagcccctctggaaaatcgatatccgccgtatagtactcgtcggtggggaccaatgagatattcgataccacgccgtttaccactccaaactcctgatccgggaaattggagaaacggacgatcgcccgctggcctctccggacttttcccgagcgtgctatcggtatgcgcaccttccccaccagccggccctcgccttgcggcacgacggtgaaagccacctctccggatgggatatattggttctcattccagtacttggtgaaagtcacgacaccccctaccggggcgatgaggcaataacgcaacctccactcgttcatgctgttcagcaattgttcccgggcggtctgtaattcctgccgtagcgtaaattctttctcgctccgctccagcgtcagatccagcaaggattgctcttgctccccgatctgtatccggagattctcggccgaggctgacgccccttccagcgaataacggctttgcagcagggaagcccgtgcggtctcatgctcgtaggaggaaatcacggaccggctatacaataatgaatcccgggcgtattgccgccttgtcaaggcgaattgctccgagagggtcttccgctgccgttcggtctcgttatagtaagccttatacaacgctatctgtttgcggatggaggccattttttgcggataataatcgatctccctgtaattgacgcaggcatggagcgccgacagtagtcccgagtaagccgcttgcatatcacccagcgatagctccttgtactttgataatgccttgtccaggctatccacgtcgcttccggatcgttccaacgccttatccagatagatggcatcgtccgtgtcggcgtgattctctatgaccgccagccaatccccctgccttaccggacgattatccctgacgagcagctcctgtatcttccccgccgcccgtgtcaccaccgccgttgcgggatgttgccccgtcaatgtcatgtcagccgtgatcacgtcaggatacttgaagaaacagctccccaccagcaacgctacgaccacgaggaataacagcgttatcccccaccgtacgatccaggccggcacttgccccatcacctcctgcacctcctcgctcctcagctctatgtccttatttcccttctccaactaattttcaattctcaattttcaattcccaagctccaactggttcttcaccaacttataataagtcccccgcaaggccgtgagttcctgatgcgtcccttcctccacgatgcgtcccttgtccagcaccacgatcttgtccgcgtcacgtaccgtgcttagccgatgcgccacgaccaccaccgtccgtcctttgtagaaggcgtgcaactgctccatgatctcccgctcgttgttggcgtccaaggcgttcgtggcctcgtccaggaagatgaagtcgggattcttgtacaccgcccgggcgatcaggatacgctgtctctgcccttggctcactccgtttccctccatgccgatcttcgtattatagcccagcgggagcgagtcgatgaaatcccggatattcgccaccgtcacggcatgcagcaggcgttccttgtccaccacctcttcgccgggggcgatgttgttggcgatcgtatccgagaagataaaaccatcctgcatgaccgaaccggtcttgctacgccatacgtgaggattcaagttcttgagggaggtatcgccgatcctcacgtcccccttgttggggttataaaaaccgagcaggagtttcacgatcgtcgtcttcccgctcccgctggcccccacgatggcggtcaccctgttatggggtatcgtcaggttgatatcctccagcacgtaatcccggtctgcgccgtcatagctgaagctgaggttttccagccgtagcgtcctgtcatcggggagaacattcagccttatcccgcctgcctgttcctcgtcctccttcccgtgtatctcgccgagtcgttccagactgatcttcgcgtcctgtagggaccgtgagaaatcgatcaattgctcgataggcgaagagagctgccccacgatgtaggtcaccgacatcatcatacccagcgtcatatccccttgcacgacggcccgtgccgcgatgaaggagatgagtatgttcgtggtctggttgaaaaagaccgccccgagttgctggtattgttgtaacgccaaccccttgatccctatcttgaaaagttttacctgtatccgttcccatttccagcgcatcttggtctcgcaattattcagcttgatctcctgcatgccggtgatgagctggaataggttgctttgttccccggccgcctgcgagaaacgctttacgtccagctccctcctccatctcatgaaagcgagtacccacgccacgtataacccgttacctaccaagaagagtcccagtatcgtccagtcgtaataggccagcacgaacccgaacacgatgaagttgacgaaagagaagagcgtattgatggatgtccccgtcatgaaagcctcgacgcggtcatggtcaccgatgcgctgcatgatatcgcccaccatcttggtatcgaagaaatgcaggggcagacgcatcagcttggcgaggaaatcggagatcaaggcgatattgatcctcgtgtttacgtgcagcaatatccagctccgtatgaagtccacggatagcttggcgataaagatcactaattgcgatataaggatcaaggttatgaaacccaggttgttgtcccgtataccggtatccaccaggctctgcgtgaggaaaggcaggatgagttgcagtacactggcggtcagcatgcccagcacgagctgtgccatctcacgcctgtagggcgatatatatcggaaaaagaatccgaggttacgtttcctgtctctcccctcgtcctccatcccgtagaactccggccccggttccagcaagagcgccgtcccggtatcctgcccgtccaccttggtactgacccagcaccgcttgaactcctccctcgtataggtgataagtcccgccgccgggtccgctatgtagaacttccctttccttatcttgtagcaaaccacgaaatgccattggttccagtgcagtatgcagggtaggggacattccttttccaattcctccaccgtgatccgcacgccctgtgtccggaacccgatcgcctccgccgcctcgctgataccgagcatagagaccccttcccgtgtgatgaaggctttctcccgtaagttctggatcgagtacacacgaccatagaacttggcgatcatacggaggcagctaagaccacagtcctttgcgtctagttgacgatatatagggaactctaaaatcacaaaacaaatctattataaaattcttgcatacaagaactaaatatttcagacgtataatatctctcatagcgtagacgagaatttttagccatttcttttcgcatagaagaatcttttaataatattaaaagtttagattgtaattcataggtatttaaatctgtgtgattctcatattcaatgattggtatatgatatcctgagactccatcctctatcatttctgataaacctgtagatgtacttgcaacaagaggtatcccatacatcatcatttcaattgccacataactacattgttcatggaatgatggtaatacaccaatatctgcgatttggtataatttgtataagtcttctttatttagttttccagtaaatgtaatcttattccatgttggattgcaagaatttaaatagtaagaataaaacccatctcctacaataactaaatggcaataagggtcaatttgcagtagttttttgaaagtaaaaattaattctcccagcccttttatttcatctaaacgaccaacaaaaagaataattttttcttctttactaaaaaggaaattctttttaagattcaatcgtttatcgctattcaataatatagattcatctttaagaccattatataaaatacaaaatttgtttataggtaaatcatatattttactcaatagattttgtgtactatttgacaagcaaataatcttatcaacttgttcaaatacatttttttctttttcgcatatttctttgatatttttttccaaaggatttttgatactgtctaattctttgtaaagaatactttttaaataagaataatttccttttattttaaagcaccaatccatataatgaatagtaaagcaacatcgtcctttagaaaaaaaagcacgaaatgtatttaacagatgaatgtgctgataataattgatatgtaatatgatattctctttactatgcgagctaaagtaaggaaatattagataccatatattcttataataagtttttattctaatttctggatcattattttgtatcgtatcaggtatatgataataatctatatctcctttgcgttctatataaaaatcattttttgttgaacgacaacatatcacgctaagatgaatcccttgcttctgtgaaagaattaaacaaagttgctttatatatgtgccaattccatattgggatgctctggattcttcattaacaagaataatctgtatcatatgcttgtcctattttattttgttttcaacttccctataaaaacgatacaattgtcatcatcagtaatttgattattcaacttcttcactttactcaatacttctgggaataatttttgagtggaagtcagaaccttttccaattgctcttttaatgcgtaaggttccatgatcgcagtgaaataacctcgattgaaggacggattggtaggcccatctatattccctagcatattccatttcaaattcacgaaacaacctttaaggctttgtttgtctactaggattttcgggaaacggggtaactcattattccatgaggtctgtgtataccaagtgactagaaagtgattgggcagctccgtgaaataatggcagatcggctcatgacccgtatgcatcgtaaaaacagggtgtagcgtattcgagtctatgtcataatgataaagtgtgtcttgcgaggctatacaattatgaagatagaagtcggaagcggtggtattcaaggattcccgtacctcataatcgtaagtgcttgggatcaacatgaattggtcggagaccggatattcttggatgatattgccttcgaaatcctgcgtccagatcaatgcggtgggagttccctgaaaaggtatgcacatgacggttactgtttttttctcggcattgatgacgaaccggcctttatgggttatataggccagaggaatgtgtttttgtggctgcccgtcgaagtcaaacactaatatcttagaggcacgaatctccattagatagattttattattactttcatctaaatactgatcataaataaataggttatattcatccggcccttgtccttgggaggagatctttctgatgaaatccccattacggttatagagcttacatgaagaacctgccctaaaagatttcacaaaaatataatggtcactcacggctatatgggtatcttgccctgcggcggtcaatgcgtcttccgagttttctaggcgaataacttgaaaggaagaaagcaaggagcttagcgataaattgaatgtatcctttacggaagaaaagtctaaattagtcaccggatctccttgcagattaataacctgtgctatgactgggcaattatccaaggtcaactttctggatacatttgtctctttatttccgcatgaggaaacaatcgttagtaacgtgatcgatacgtaatatatgattctattcatgaccttattgatttaaataacacatattatattcattggctactatttcataattagatatagaaggacatagatacttgtttacgcagtttttgcatgaaacataatctcttgtaaagaaccaaggtttaaaatagttttctatttcagaataaacaatttcagacaatttttgatcttgaatatttccaatcgtaggaaagtttacgttagaatacacttctcctgtagggaaaatggttaatttgccaaaaagattatcattcagtatttgttttctgaaaatatgctgttttgtgtttttttgttctataatatctttaaaatcattataaatatattctttgaagaaatccatattatctcctgtataccaaggtatataatcaacatttgtgaatttcccgaggttgtttttagataaaaaaataacgtcattcttattagaagcgattagactccaagtgatattatattcattaaataagtttatataactatttaactcttcataatctacaggtaaatgaaccattatcattattgaaaattgcggatttgttaacaattgtttcaaatcttctttgttgtattttttatatggtaatattatctgtgttttaatactgtactggcgggagagtgataacagataggaaaaaagctcttttttttctattgtagccggtatgatatttattttatctatttgacaaatagataattgttctattatctctagatattttgcatgtgataatttttgtttttctgtatatgtgggatataagaattgcttatagcaatctttatacattggatttaaatcaaaaccttgattttctaaataaaaggtcacttcatggagatgaaatagtgcattttctcccagtaaattgtattcttttgtctttggattattaggatgatgaagaatccgtaaaataggcttagagataaaaggtggaatacctctaatgtttttgattatatcacctgaaaatgtattccttatcttttttatgaattctgtaaattgcgaatctcttaattgatactcataaatacctacacaataggttttatttgtattatgaagaattgataagactgtatttattgtctttccatatagggaacaatcaatataagttgaatttaatgtattgtatattacatattgatttttactgtaaaaaagaaatgtgtaagattctaaatagaaccaatgagtataattttccatgttcaatctattaatatttcgttttctattctatctaataaatcaggatgcttttctaaagcgtatatgtaggtggaaaaatatcgattgacatcttcatttccaagataataaggacatacggtttgaccttcctcatctttgggtaaataaaacacgcagatctcacaatttttccacaacaagcattttttgcatttatcaactataggagtataaagtttcaaatacagttgtttaacttccttgctatccaaatttattttaccatctctcacatagcctagcggatactgttgtccaaccttctcgcaaggtaatattttcccttgtactgtcaaaaatatctttttagaaaaaggtacacaggtgcttgttggaaaatatttgatatctttatcttggaaaaataggtctgggatggttttgtaagtattgccaaaatacgattgcatgaaaatatctaattgcacaatatgggaatcatctgcaatctccttcaaatagctacttccacagtttaccgcttgctttatgctgtcttctttagaatgaaacattctattaaattcttctttcttgtcttcagcaattccatttctattcaattcagatatataaggtgttttgtcaaagttagtctttatgtagctataaatttgatcaacagagtttttatcgtgcaatacagagttgaaatttacattggaatcaaaataattaggatgattatcttttaattttttgatattagcaaatacaatatcgaaagactctttcccttccttttttacccgatatatattattctgtttggatccatcaatgcttatcaataaatgcacatcattctcgacaagataattcatatatttaggcaataatatcgcatttgtcgttaaattatatacaaatgttatcccctttatcttcactgcatttaagtagttaattattttttcaattaatatcatattgactaaaggttctcctccaaaaaatcctatgtttatggtattattgaatgatatattacgatatgatttccatagtgatattaaatagtcaattagaattttaacattattaaattcttgtttgcctctattgcgttcatcttgatttgaatataagtctccataactacagtatttgcaagataaattacattcatccgttacctcaataagtaattgatttaggtttgctaactctgattctatacaagaggtatcatattcaatctccatattggggatttttttctcgaaaaaattattctctctcaagaagaaatctttttgtttataatattcatatgcattcttgtccatatctatatcaacatattcattttcagagggagacaataatatgctatttatatatgaactataaatatatgtatatccggattttgatataactggttgtatcataatttattatttaattagcttttgatatcactagcatttcgcacatattgaaattggtataatagttaattgacattcaatatctatcttagtggaagtaagaacttcttatttctttaataagaaataagaagttctttaaagtgacagatatccgctataagatacatcttataacagaaaaatcttatcttacttcagaaaaggttagtaaccccatccatatccaccacccggagaataaagatctcctgaatgatttgcgctagcattagctgagccgcctccacctccgcaaatgcagcatccaccgcctttgagtttttttagctcttttttttctaactcatttttgctgagttgagaaagtttcaatttacgtacttgtttcataacgataaatttaaattgtttataaatatgaaattagccagaatagactggtgtttcttctaatatccatctaagtccatatcctgaacttccttgatgtagaccaagttcccatgaatggatatcctcatttttgggaaatgatcctataatttgcaatatagcttgttttttatccaatattatcttattattacaaataagattccattctaataaaaatagatcatcgaaatttgtatgaattgctgttatatctgcgttgttaattcgtatatttatataactagatattcccattagtcctgtctccaaactaagatcttttattcttcgtaaatcccgctccatgacttttttatcgatttctgtaaggatttcattggaatccccttccatgaacccattttgaattagatattcgattccccagccgattccacataatccagtctccagatttataggcaatgtctctggaatattctcgcagatttcttcgagcagttcccctgcaaagtcatcatatatagctgagtctgtatatcttgcgtagtgcgcaaagaatagcacaactcccatctttccatggaataaaccaatatcctctatgtcgattgaatgcaaaatcagatgattcgctattcttcgtaataatatgtctttttctgtattcatcttaccaacactcaattttagtatttaaatcttttgcaaagcctagcaataattctttttgataagttttgcttgatgtcaaacaaacaaccttacttgggtttaagattcgtaaaatcgtctcaaacgtatttgcgtataagaacagtctaggaaaattttgttcaatgctatcattctcaaataccttttgttcggaaaattcaacttgtacagctgtaactgtttccggtagttctgtatcatctggaatctcatattcagataataatagaattggaatctcttctttttgtaaaaaagtcgatatatgagccaattcttccttgtccactaggtaaaccaagcaacatcttttatatggagataaaagctttgtccaaagatgattatctatattaaagttatttgtggtattccttttcttttctatccattcaaaatgattcaagaaattagagatgttgtgaatagactcctcgatagattttccggcgatacgggaacgtatataatccatttgttctttcgaaatgaaagacagtatatatacgaacaatgcgttttttatggaatggttgccaagcatgagtcttagggtatcccggacctcatattcttgaatagcagttcttatatattcttgtatgattgtatcaaactcgattttgtattttcccaaatccagcgaactcatcttttcttgagactcctcttgtctccaattttccaatgtgcgccaaggaattgaatgacgttgcgcagaatagaaataagaaaacatggattcaaagcgtgaacgtatgaataaatttttccttcttttcagctttgaataattacatttcttgaatttttctagagaaatgaagcgatcctttgctttttcataccaatattgataagtttcagtgtgcttttgaagacatggacgtaaatgaaaccatatcagaccaccatcaaatagctttttattgtgaaacattacttccagaacttgattgtagccgggagcttttggcaaataacaagcttggtaggtcatttcttcagagacctcgaaaaagaaaagatctcgcactccgttgaatgggcatagaatgtcccggtaggttgtgtctatcttttcgtctcctaaaaaagtaagccattctccgtttttttgtaacacattgataccagagagggataccaatattttatcttgcttgattctttttttcaaataggaaaaatagaaaggaaccatctttatcgctaaccagtcttgccattttctttttggacttttgtcctttttaaaattatgcaggtaagatgtatatagcttataagcaatttgttccaaagggttgatccggactttttgctcggtgcggtaggcatcacaatattttttgaatgattcggaaaaaaatagctgatctgaatctatcttgatcgcatagcgataggttacttttgaaatcgcataattcgtgtatccggaaaggagatgaattgaatccttcggcaaattcatggtctcttggaattgttcatccgttaaatctataggatagatatagggttggtattcaaagattttgatcttgtaggggtatttgctctgttttcttttaagtatattagctgtctcatctgtacaattgtgatataccgcaatcagctcatctaatccttcaatacaggactctatgcaagcgtctaggaaatccgcactgttttggcagcgcaatatacccgttacccctaaagggcgttcttttgtcaattgtgataaatcgacagtgtattcggtatagtcctgttgcttagagctcatggtaattaaattattgattcatttctaattgattttgagaaaaacaagtttcccaaatttttttctgtatatagctctctctataaggactatatggcaaatctctttgtgcatcttctcctatgtactcttttctaaacattaaatatgtatgataatcttttagtgtatcgtcattcaaaatttctgtttcttgtatctttatatctatatccgataatacatctttgatctcaccggtaataaaacgttctcttaatagataggtgattccccatccaatgccacataatccatctgacaaatcaagagataaatcatccggaagctccattatagattctaatatctcgtccgcgaattgttcatataaagcatctccactataacgactgtattcataaaataggatagtcatgcctagcttaccgttatacaatccggtatgctctagagcctctgttttcagtaccccgtaacggagtaggtcttttagtatgcctttgtattgaatgaataactctttcatatcgttcattaattgtaaaatgaaaaattcgtaccccagctaccaaaaaaataatgagaacaatatgcttcctttattttttcatggaatgaggcggtctctccctgatagatatatgaacccatgtcatctttcgtcacaggcgttacttttgaataagggaaaagagtaaccttgtatcttttcttcaaggtattaaatatccgtgatatcatcaatgggcctgttgtatgcatcaccttttgtgctggatagtcccgtaacattgcatcagtaatttcttttaaaatgtctatccatcctccgcatcttggctcagaaaccataaatgcatttcctattagggtggacatacttgagttgaaattatgctccgggggctcttcgccaaatcctatcatcacgtcttctaataatggctcgataggcttaaaacattccgtatccaaatccgtatagactcccccatatacatataatatcatatagcgaatcgtgtcccaacgttgtacattgtatggaaaacttctatacatggaaagatactccggaaaatgtttttctaccaactcatccatttcctctccgttccaaaggtgatattcccaatctggattctgctctcgccaagttcttgccaagatttgtaagcgggtgggcatacatggttctgtacgcccctcccagacttgatgtatgattttagggattgccatatgctttatttaatctcgaattctccaactagccatcctaacttatgaatcaagactgcttggtatgtgtctgtttctatcccgtccaatggaatgttgataatatctcctgtttctccggaaagtatattctcatacattatattacctgcatgatccatgatgcggatcgttagatcatttaatgcttccgtgaaatgaacactcaaaatatttccttctatagataaggtaggaggtaatacgtggatggagcgataacgttcatcatcccatttcccgtgtgccgggatgtcatctccataagcaaatgtgatggagagaaatgatcctaaaagaatacataaggctaacaaatgtgttttcataacgctattactatttttattagtagtgtaattacgatttgtgttgataaagatcagtgaaaaagcaacagaaaaatgaacaaaaaacgaacaagagcataattatgcaaaaaagatttgtgcattttttgtttagttccttggctgatatctagtatagtgttataaattagatatatagcagtctagatctttggcatttcccttcttgccagttaacttctcatataatctttttcgataaatggaggcgtttcccaaattgagtaggatcgcgatcgctcccggctttacccctattttgatcagatagcagatctttttctcggattcgttcaagggaacagactcttgtaaacctatcgcaaagttggggaaacacgcttctaccgtaacgaaaagcttgttccaatcgtcgtttgttggagtccaagatatgggggagcgaaacttgtcatacaatcgtcctacctgtaattgcgctaacttctccttccttgtttcctcttggtttcttaaattggaattctctgttttgaggatggaaatgtctcgctccaggctttctttgatatgggataatttctcctgttgttgttcttttattttatgttcctgtatgtcatgtagcaaactattcttgacagaggacaagtcttttatctcttgctcttttttaaggatttgtttctcattgtcttttaatcgtcgtaatgcgttttttcgctcctgcctataacggatgaacgtgaaaatgcttcctactagtagaacatggcagcctattatggataaagtataaaagaacttctgttgggaagcgtaaagtcgtgcttcccataagtctcgctcaatgtcattgtatgaatagaacgcttgtacattccggatagattcggcctgcatttccttttctatagaatcccgtatcgactcgtatctatgggataatgaagctgctagctcccattgcttttgagcgaaggcgatttcttttaactggaaaagtcctccggcacgtgtcttaggcaaaggtgcggaatctgcgcatgcttgtaggtagaaacgagctgagtcaatttgacagttttttttataaagttcaccaagcactaggtatacgggatatttggcttgtggtttcactatattttgtaaagatgtctgtaataatccatgtgcttcttccaagcgttgttcttctatataaaggccggccaattccgtataaacggaagggaggatgttctttcccattaaggcgatcgctttttggttacagatgatcgcactgtcttgatatcccagcatcaagaaggttcggcctaagtcccgtaacgcaaatacttgccccattgagtcttttagcatacggaaatcctcaacggcctttttctgaaagggtaacgctttgtcgtaaaccgtttggtaggtatagagcatacctatattattattgattctgccgagtaacgcatagtccttaatctgttcctcttctctcaatgccttgagataatattcctgtgcctttaggggctgatttaagtcttggttgatccgccccttatagaaccaagctttcgcttttcgttccagatcgtctgtttcctcataataatccgtcgcgatcgtgatcagcgagtcggtttcatgcttaacaaaagtcttgtcttgtgcttctgttaacagcaaataataatgtgccttatcttttcgggataggttttctttgttctctatttgttcaaggagcattaacgcgctatccggatgttgaggcataaggttctctactttccggaagtctatggtttgatgccccatcccatcgcaagagatccatataataggtattagaattaacaggaaaacaatgtttttcttcatttgcgtgttatttgttgagggtaaaaataatacaaaaagacgagaatatcttggctggaaatcccgactttttggatctatttttattaccattaaaacatattgaataacagacggttacactagaagcaagtcatccgtttatggcttgacaagtgaataactaacggcttgtcaagtgaataactaacgagtaggggtagccgtcagttaacggcttgggaagtgatcagttattcacttgagaagccttttcccagagaagatatacttactttgccgatgaagtatatcttctccgggcatagaatatatactgcgttggccaagtaagtatatatggataaaaataggactttttcaccctaccagccacctctcgatattccgggtctcggaggagaaattcgcgccgatctttaagacctcccggtcgtctccggcgaagggtagggcataacctttctcctcgatctgccgcagagcctcctctgcggttccgttcagcttgaactccataatatagacgtagcggtcggtttgtaggacgaggtcgatgcgtccattcgaggtgtggtattccacttgcgtgtacagtccgaccagcttgaagacgatgaagagcacgttgcggtaatgcagctccgtgtcccgttccgggttccggccaataatcgcctcgtaagaggtatcggcgaagaagctttgtaggcggtggaagaaggcgtcgtagtctcctgcccgtacctctctcacaaagcggcctatctcgaaaggagacttcgaggcttgaatgttcgtatagaacggcagtaagtatttcatgaaaccctcctctacctcttggttggggaaacctaagcgatagatcttgaattccggctcgtaatccttgatcgtgaggtatccgctttggtagatgacggggatgggattgttcgaagcggagtcgatgctgttcaacacgtcggcgtcggtctcggtgttggccatgtcgtacaggtcgtaattcgttcgtttcagcaactccaccaagtaagtgggcgtgcccgtctcgaaccaataatcgctgagccgcatatacttgaaggtattcagcaggctgaaagggttataaatgcccggtcccccggccacgaaatgatagccgtcgtaccgtttccgtagcaaggatcgggcctcctcgtatgtccgctcaagggcagaggccaacgtatggatgtcctcatcgaaatgcgtacgcagctccgtttccgtgatgccgcaaatggcggcgtaaggctcccgcatggatatatcgtccagattgttgaggtcgctgaagacgcttaccttcccgaacttggtcacgccggtcagtagggcgaagcgtatagccctgtccatagtcttcaacacaccgtagaagggtttgagcatgttccggaaccggttttgcatctcttcgtcgtgcaagttctgtagcaagggcttgtcgtactcgtcgatcaggatcacggcccgctgtccggttttgcggtaggcccggtcgatgattccggcgaagcggaggggcagggtctcctcggtaggccgtgtcccatactcctcctcatatctggacaaggtatcatttaatatcttatacaagctgtcaggggcgtcgtagtgggagatattcaagtcgaaatgcaagatcggatgcttggtccactctttctccagcttctccatggccagtccctcgaacagctcctttttcccttggaaataggcctccagcgtggatagcagcagactcttcccgaatcgacgcgggcggctgaggaaatagtagcttcctgttttcaccaattgatagatcaaggcggtcttatcaatgtagagatagccgtccttgcggatcttctcgaagttctgtatgccgatggggtaaatagtctggttcatatcgtcttgtgtttaatgtgactcatagacaaagatatgaaaaaaacacgtacatgttttcaaaaaaagacgtacatgttttcggaaaaacacgtacgtctttttttaaaggctttatagagtatgattctacctagtacttgaagcttcctccccccaagaattcacggagcaaggaagttccgggaagttcctccgtcgggatgtaattaaagtagcggaggaaacggagcaaacgatacgcctccgcattcgccttactactctccggcacttgcgcgaggatcggttccgcaaatttgcgcaaggcggccagctcatacaacatggcgctgttaaacatagcgtccgcattctcctgatacggaaagatccatttatcctcaccccggcgaacgctcggccaacggttgatcgtatcttccgccgaatatcccctaaagcgataatcccggatgatacggcgcagcagacgattatccgtcgtcggtatccaattatggttatccaaagagatagaggtcaagaccgagacatatacccgatatttatatttatcatcgataaactccgtcagctccggattcaaggcatggataccttctatcaccaagatcgagttctcacgaagcttaagcttcttccctttgaaaacccgttggccggtctcgaaattaaaagtcggcaaatcgatctcttccccggataacaacttcttcaaatccttattaaaatagggtaaatccagcgcatacaaggattcaaaatcatactcgccatgctcatccttcggtgtatcttcccggttcaagaaataatcatccaaggaaattcctaccggatgaagcaggttagttgttaattgcacttgcaaacgcttgcaaaacgtagtctttcccgaagaagaagggccagagatcaagacgatacggatgccctctttatatccatcggcgatcttttcggcgatcttagcaacctgtttttcctgcatcgcctcagagacaaggattatatcctgagagcggcctttctctatcgctaaattcaaatcccccacattatctaagccgacagtccgctgcaatgtaaggtgttccttataagcctcgaacatcttatcctgcttgatgacaggctgcaattccatcggatcggtctgcttcggaatacggagcaaaacgccatccatatacggttccaagtcaaacaattggatatagccggtcgaaggggttaaacagccataaaagaagttgatataaccttccaactcataataagaggtataaggcaatcccgccgtctctattaagcgagccttatcattcataccccgctccctgaacaatacggcggcatccaccgtacggacactcttatggaggaaaggaagatccgcgtcaatcaactcccacatacgtttcttgatcctctcgatcgtctccagatcgatgttcttgccgttatggatcacgcaatagtaacctttcgacaccggatgttccagatttaaggtcgccgtcggccaaatatcatacaccgccttggaaaatatatggcaaagcgagcggacataggttctcaatccggataattgagtatagtcgataaattcgatatccttcggttgccagcaacggaagttcaagctttccgtcttattattcacttgcgcgttcatcggcctgtaccgaagcggagcgccaagcgccgtataaatgtccaacaacgaagaaccaatgggtacatccttgtaggtattattatttttgcagtaaattgttattgtctcagacatactatctcagttattatttgtaaattcgccccctaaagttaggaatattaatcggatatacaatccacttaaacgtaatttaaatggactattctttttttgattttctccggctgatcggctccttggcgctgttcttgtacggaatgaagatcatgagtgaagggttacaaaaatttgcgggtgacagtttacgtcgaatactaaccgcgatgaccacaaacagagtgaccggtgtgctcaccggcgtgttaataacggctctcatccaatcctcatcggctacgacggttatggtcgtgagtttcgtgaatgccggactcttgacattgacccaatccatcggagtcattatgggtgccaacatcggaaccacggtaacggcatggcttatctccgccctcggtttcaaggtcgatatcgccgcattcgcccttccccttttagctttcgctctcccactcttcttctcaggaaaaagctctcgtaaatcaattggtgaatttgtctttggtttcgcgttcctgttcatggggcttcaaagcttaaaggcaaacgccccggacctcggagcgaatccggagatgctggctttcgtgcagaattatacggatatgggatttttctccatcatcttgttcttatttatcggagcgatcttaaccatgatcgtacaagcctccgctgccacgatggctattacattgattatgtgcgccaacggctggatcgattatcatttgggagtcgctttggtattaggcgagaatatcggaaccacgattacggccaacttagccgcattaaccggaaacacacaagcacgacgagccgcgttagcgcaccttgttttcaacgttttcggtgtcatgtgggttttggtgctcttctaccctttcacgaatgccgtctcatggtttgttacccatgtaatgaaggtcagtgatccggctgtggcggtatcctttaaactggcagcgttccacacagcattcaatatcagtaatactttcattatgatctggttcgtaagcttgatcgaaaagaccgtatgtacgcttatcaagcccaaggtggaagacgaggaataccgccttcgctatatcacgggaggtatgttatccaccgccgagctttctatcctgcaagcgcataaagaaatctcattattcgccgagcgtacggctaggatgtttaatatggtgaaagaattattctacgagaagaatgaggagaccttcctcaagacttatagccgcatcgagaaatacgagaatatcagcgaccgcatggagatcgagatcgcaaattacttgactgaagtatcggaaggccgtttgagttctgaaagtaaggaagaaatccgtatcatgctacgtgccgtctcggaaatcgagagtatagcggattcttgtaataaccttgcccgaagtatcaaacgcagaaacgagttcaaatccgaattcacggaggagcaaaacaagcacttggatcatatgttcgagctggtatccggggcgttaaatcgcatgaacctaattttgcataaaccggaactcgtacatgatgatatcaatccttcttataacatagagaacgagatcaacaactaccgtaaccagttgaagagccggaatatcgaagatatcaacaataagctgtaccaatatcaagatggcgtttattacatggacatggttagtgaaagtgaaaagctgggcgattatgtattaaatgttgttcaagcggttatcgagaagaaaatatagtgtatatttgtccttaacaatatcaacagcccttttccgttattgagagaagggctgtttttaatatatatccactatgaattataagtattatacgatcgttatccttggccttttagcattctccgcttgcgagaaagatgatatcgatattccggcaaccgacaatgaagtaaatcaatggatcgagcaaacgatgcgagagaattatctttggtattccgagttcccggataaaagttccttggactttagtcttgatccggagagcttcttcaagggcctgttatccgataaagacgggaaagagctttctgatggccatcattacttctcccaattagagaaagcgaccgtaacaaagagcatttacgacgcgaacaactcatacggattcgatttcgcgacttccaaccttaaagacggaggcaggacctataaaatagccattgtcctttatgtattaaaggattcacccgccgaagaagccggattgaaacggggagactggatacttggcgtaaacggctccttgggttctatccaagactatgatgtgttgagaagcggaggcagcgtatccctccaactaggaaaagaaacaggaaacaccaagggattcgtctccacccgaagagttaccttgaacgcatcccgaacggtagaagacaccccattcctaaaagattccgtatacacatatggcaataagcgaatcggctatttgatgtacaaccatttcgcctccggaccgaatgaatacgattatagcgacactagttataatctttatttgcaacaactcttcgaaaaattcaaaagtcgcaacgtcaatgagttcgtacttgatttacgctataatgggggtgggcttgtcaattgcgcccaattactggcttcgctattagtccgtgaaaacgttttaggagaacctttatgtatcatggagtataacgataaaaactccaataaaaatgagaccttacctttgctcaaaacgaccgaggtcatggcgggaaacttaaacctacaacggctatttgttttgacaggttcaactacggcttctgcctccgaacttatcattaactcgctacgatcttatctagacgttcgggttatcggtaagcagacttttggcaagaccgtcggtatgacgatctacaatgaatctaaaaaatatggctggatactttctcccgtcactttccatatttataataaggatcgggaagctgattatgaagacggatttcatcccgatgtagctatcgatgaattcaagagtgatctagctgaattcggagatttgaaggatcctttattaggacaagctatttacgagataaccggccagtcaccgctcttacgatccgctaccccgaggggcaaccgggaaatccaatataatcccccgttgtcctataaggataacttattactgattccaaaagactaaaaacaagatatatggaaagcgcatttcttaaaatcataaacgcaaaagtattaactccttcgggtctcctaccaaacgggcaaatcatcatctcggatgggaaaatagtggagatcaccgggcaaaaccgggagattcctcatgcggagatcatcgacgcaaaaggatattatgtggctcccggctgtatcgacacgcatgtacacggcggcaacggacatgatttcacggaagctaccccgaaagcgttctatgcgatcacaagagcacatgctttacagggaacaacggctttatatcctacattggcagctgcccctatcgataccttccgggaagcgatcaagacctgcgagcacatcatgaaccacccggaacagggagcccgcatcatgggattacatctcgaaggcaactatttgaatatggctatgaaaggcggacaagaccctaattatatttacccgcccgatccccaagaatataaggaattactaaacagtacccaatgtgttaaacgctggagcgccgcccccgagcttgacggggctttggaattcggtaaatatgcgtcagctcatggtgtgttggtttcactagcccacaccacagccgattatctccaagtgaaaaaagcatacgaagccggattcacccatgctacccacttctacaatgccatgacttccgtccataaagaccgtgagtataaacatgaaggaacagtagaaggtatttatctcatgaaagatatgaccgttgaagttgtagccgatggtatccacgtaccgccggcaatcttaaagttggtatatcaaatcaaaggggtagaacgtacgtccttaatcacggacgcaatggccgccgccgcttgcgataacggtacggaacattttccggactcccgggtaattatcgaggaaggcgtatgtaaattagccgatcgctcagctatcgcgggaagtatagctaccggaatccgtttgatccgtaccctagtcgagaaagcggaaattccattgcacgacgctgttcgtatggcttccgaaagcccagcccgcctaatgggtcttttagaccgtaaaggaacattggagaaaggaaaggatgccgatatcatcattttcaacaacgatatagagattcaagagaccttcatcgaaggtaaacggctctccaaagaataagaaatccaataaacaatgacttctcctatcttgtttttagataaataagggcatgaatgtatatggaaaacgtaaaagaacattactggagatactcattgatcaccattatattaggactaggggtaattctattttttaagattaccccgtttcttggaggtatacttggagcattcaccatctatatattgctgcgtggacagatgttccatctgacagaaaagctaaatatgagaccagcttttgcagctttactgttactgggggaaacaatcttatgtttcttaatcccaatcacattggcgatctggttggtaatcaacaaaactcaaaatattaatttagacccgactgtactgctaaatacaggccaacatatagcggatctagttcaggaaaagaccgggtttgatgtactggatagaggaaacttattaaaagtggcctctatactcccacaaatcggacagtttttagtgggtagcataagcagtttcgccgtaaatgtcgtcgtcttgattttcattctgtacttcatgttgataggcggaagaaaaatggaaaactatctatacaccttattccccttcagtgatcaaaacaaggatgaggtactcaacgagatcaatatgatcgtaaaatcaaacgccataggtatccctcttttggcggttatacaaggtatcgtagcggtgatcggttactttatctttcagactcccgatccgctgttatttgggtttctcacttgtatcgctacgatcattcccattgtagggaccgcattggtctgggttccgttggcggcttatatggctttaaacggagattgggtacatgccttgggattggctatttatgccttgcttgtcattacgaacgtcgataatctgattcgttttatcctacaaaagaagttggcggatatacatccgttaatcaccgtcttcggagtcgtaatcgggttgtccttattcggatttatggggatcatcttcgggccgctgttattatccttattccttctttgtatagatatcttcaagaagagctatttggataaataaagagtatctacaggacagggtatcttaaaaagtcatacctttacactacattttgagtaaaatgaattaatatgtcacgtagaacagtaaacaattggaagcctatcaaggggcaacctctcaccgaattagacaagaaaatcctatatatccaaaataaaggacatttagtacccacccgcaagcttatcaagactccagagcagattgagggcatccgcagaagtagcgtgatcaatacaggggtgctggatttaatccagaaggagattaaagaaggtatgtctacagctgttatcgataaattggtgtatgattatacggtagggcatggagcgattccagcccccttaaactatgaggggttccctaaaagtgtatgtacctctatcaacgaggtcgtttgtcacggtattcccagtgagaaggagatcctaagagacggtgatattattaatgtggatgtctcaacgattttagatggttattattcggatgcgtcccgcatgttcatgatcgggaacgtatctccggaaaagcagaaattggtacaggtcgccaaggaatgtctggagatcggtatgaaagcggcgaagccgttcggattcgtcggtgatataggcaacgctattcaaaagcatgcggagaaaaacggattctctgtcgtacgggatttatgcggacatggcgtcggtctggaattccatgaggaaccggaagtttgtcatttcggacgaaaaggaactgggatgcttttagttccgggtatggtctttacgatcgagcctatgattaacatgggtacttggaaagtatttatcgacgaggaagacggttggacggtcatcaccgaggatgaactaccctccgcccaatgggaacataccttcttgatgacagagacaggattggaaattcttacctattaatatctaatgcaattaacgcttccgggccttttcccgggctaccttttccttttcccgcaaggcttccttgcgggctttttccttctctttcaatttttgcttgtataagcgttccttctccttgcgctctttttccttctgtttcaagcgttgcttataagcacgttctttttccttacgaaggtcctcacgagctttcagtttcgccttacggtcggcttccgcttgtttcagcttggctttgcggtcagcttccagctgtttctctcgatcagccttcgctttcaacagggcacgttcttcctccgcttgcttcttgagaagttcttcctgttctttcgctttctgctcacgtaattccttatccgccttttgctgggcctcgaaagccttacgagcctcttccttgcgggcttcttcttcggcagcttcccgtttacggatctcttggatttctttcaaggtcatgccttgatcctcaaccgccggctgaacaacaggaaccgtatccttacgaagggtatcgacaggctggatttccggtttgtcaaacgcagggacctcaatcgtatccgggacgactggcatagcaagctgtcggacaggttcttgaacagaccgttgttcctcctccggctctgtaacaggttgtttttctggttcaacttctggtttcaattcatctgccttttccggcacttcggcttcttcctccgtgatcatttcatcttcagtcgcctcctcctccttagcggcttccatacgggctttccaacgacctgccagatccggtaattcctcaccgaagctctcatcgaagaaggtgatatattcatccaaggtcttgccacgcatcaaggtctcataattatcatcagagatcggtaacacggcaaccgctttattcaaggccgtagcataaccatccttaccgtatatcatcttataatattggataatctcatcaaaactaataaatcctttaatcgccagcatactgatcgggccggcctgctccaaagccaaatcaaactctttcaccatgaagttcgcaaagttataagcggcgacagcgaatagcaactgattctgatctacgctacccgtaggatataccaaaagcatctgataaggcgtattccgttccggattaaatacacgggccgaatcctcggcagataacataccatcctcgcccaaaccgaatcgtaagttccaactcatacctttcacaccgccctgcaccaaggcacgtccccgaagaacacctttcaacatctccccggccagttccgtgacatctgcgttcggatacttctcgaccagcgctttcaaggcattcttaaagccttccgcatccccggcctgcacatatgataacgcatccaagaacatgaatttaggcatcaatgtagccaatggatatttctcgcttacgtaccggaaactcttacgtacatacgctgtatcgctctccagataacggtcgtaagtagcttgatagatcgagtcttgtaccacatccatcatgcggatattatactcgtaattcggatcagccacagctaccgcataatcgctttccgggaaggcgttcattagtttattcttatactcggtagccaacactgtatttccagttttcagggccatcaaatatacttgataatagctctccaaacggtgctcattatccgggaaacggcgttccaaattctcgaatgcctcgacagataaggggatatcctccaacttatccttatagatcatcgccatattgtaaagaccgtctataataataatgttagaagcgtctatatcctcttgcgtgaaaggtagctgctgtaggtaatactcacgggtatgcggatcatcggcggcaacagccgacaggtcaccgcctatcgaatcggtcggcaacggctcaccgtccggccctaccatttgggtggaatctccctcggccagcatctcctcatccagattctcattaaaggtagagagttccttcttacggcggcgccagtgatcttccaacggacgacgtccccatttacgctggaactgtgtctttccttgcgctacggtctgaggattatagaaatagaaagacgctccaccggacgcattcggcaagacaacagcattggtttccgtaccgggacggtcgattccggtgcctttcgcttcctgctcggccagataagcctccttctcagccaaggctttcgcctcttcctcctctttctttacctcctcaatcttcttatcgataatcgctaaccgctccgcttccggcaatttagccaaggcttgcaaactgtcttgaagatggaccgcttctacatgcacgaccaattcatccagaatcgccgacaatttagaaacccgttcataatccctgtattccttttgaattccggctaaggctccgctaaagcaaggttgcgctttcacgtaatcccgcatcgtaaaatagatatctcccagctttatctggcagatcgccttatccattccattcaatgtactcttatcgataccgagttgatagttctttatggcattcaccgtatcttcccggctgaggtatacatttcctaaagcatagtatacttgatccagataatccttattcttctggcttttcgccattttctcgagcatcttcaccactttcaaataattcgtacccgagaatacttctgtctgacggatacgtgaggcaaattccaactcatacggaggattcgaacgggctacctcaccaaaggtcttataagccaagccatctaattcttgatccgcatagatttgtcccaaaagatacttcatccgggtacgttgcttccggtttttctccgccttgatagcggtcttcagataagggatggcatcctcgaactgcccgttcttgatcaaataatcggcatacaccgccgcatattgcttcaagacggaagcaggaataccgttcttgttcatcttatccaagatatcctcggattcatagaaccaacccatctcggaataacaacgggcttgccacaaacgggcctcggccacgacctcctcgtccttcgcgtaatgacgggctatataggaaaaggtagcggaggcttgcaggaaatcggcattgtagaattgcgcctgtcccatgatcagccaactattctttaagaaagggttatactcctcttgttcttggatagcacgtagtttgggattattccgccagcccggtttcttggccggtttcgcttttatggagtgtagcttaatagctttattacttttctcgatcgtccggtcgaaagggccgcccggctcggctttgtctttaggctgggcgctaatcggatacatatagatcctgtcggaatagttctctttatatccgtcctgttggcttttcagtgcctcgtcaaacgcttgttttccattgaaataaatattataacgggtcgtaaaggcatgataaaaacggctcgctttcgtgttcttcttcgtgctgcacgaccaaagcaagagtaccgttaataacgccactatgtagtaaaacccttttttcattctttaattaacgccgtaacaacggttttattgctttcaaggccaaaaagaggaccaccaaaaacaagatgataaacgcaccggaaggcacgttcaggaaataagaaagaaccagtccggacacgcaacccagaaagccgatcgcgatacttccccatatgatcttcttgaagtcggaagtaaacaggtttaccgttatttgaggcaaggtcagcaaactcatcaatagcataatccctaccaaacggatcgaaagaacaattgtcatggcgataaagcacatcatcgtatactcgatccattttaccggtaggccttgcgtgacagcgaagtcacgatcgaacgccacgtaaacaatctcacggaggaaaagggagaatatgagtatcaacaataccaccaaccctaaaatccataagatatcggccgtagagatcgttaatatattaccaaatagataggcggatagattcggggcgtaccccggggtaaggaagatgaagatcactcccaaagccatacccagcgaccatacgcccgctatagcggaatcctcccttacgttttgcgtcttgctcgcccactccacgccaaaggcagagaggatcgaaaacaacatcgccatcaagatcgggtttgttcccagataaaaacccaagcccaaacctccgaacgaagcatgcgtgatccctccgctgataaataccaaccggcgggatacgatgtaagtcccgacaatcccacaagcgatggcggttagcaagctcccgatcaaggcgttctgaaaaaaggcatattgcaataaatccatatgattcgtttcctaaattaatgagtacggcgttcgccaatgatcaggaatgcctcatccttcaaggcatccggcaaattgatccctcgcaattgcaggctacggagccaaccggccacctccacttcccggagggtataaagcacttcactaaactcctcaacggcttcctcatcgtaagcgtccgcttccactccttggaaccgatccagttcctcatcgttataatattcgattttcttgctgacggcggctaataaactatcccgctcgcaagtctcatgttgtccgcagcaaacctccggaatctcctgtgcctcggggatctccgagatctccccccgttccagcatcttctgaagtttcttattccggaaatacccggcgatagcggctacgacacccagacctataagacttatgacaatgtaccacataattcaattgaaagttgagaattgaaaactgaaaattaaagggctgattccctaatagagaaaccagcggccttaagatcttcccaataatggggataactcttgctgaccacttgcgggtgggcgatctctatcccctcgggacgtaccaaagcggcgggagcgaatgacaaagccatccgatgatcctcgtaagtggcgattaccggatgcgactccggttccctgcgttcaccgttccactccaagatgctatcattgcgatccgtcaacacataacctaatttacgaagctctgtcttcaatgcctcgatccgatccgtctccttgatcttcaatgattgaagtcccgtaaagcggaaagggatatttaataacacgcaagtcaccacaaaggtttgagccaaatccggttcattcacgaagttataaaccaacttctcacagatatttccagtatgctttaacactactccacgtttcgtataagtagtgcccactcccaattgagcgaacaacttcgctccggcggcatctccctgcaagctattcttgaataaacctaacaattcgatctcagcatttttcgataacgccatgatctcataccaataagaagcggcactccaatcggattccaccgtaaaacgaatcggcttatactcttggggaagtactttgatcgtattctccgtccaagaggctctcactccatattgctccatcaattgcaaggtgatatggatatagggcctagagataatagcgccctccaaatgcaacgtaaccccattttctgttaacggggcgatcatcaagatagcggatatatattgagagctgacatttcccggtagcgagatctctccgccttgcaaggcgcttccgaaaatacgcaaagggggataaccctccttctccatgtactcgatccgggcgcctaaagcgttcagcgcatccaccaacaccttgatcggacggttcttcatgcgttcggttcccgtaatcgtccattcgcccaccaccttcgagaggaaagcagtaaggaaacgcatcgtcgtacccgccgcacccacattaaaatcccgatcgttcgagtttaatgcctttaccatcaaatttgtatcatcgcaatcggataagttctccacatcgtatgcgctataacttagcgcattcaagatcaatgccctgttactgatacttttagaagcgggaagctttacggtagtccggatagcggaacccggagcatctatctgataattcatcgctttcgtatattcaagattcaagaagcaaaagtacgaaaattagcgtacatatggagtataactgcgggaaactttctttatgcttcttttcgaatgcgaatcgtgacaaggcattcgtttgaatcgccccaaccagtagacgggaggggcaataaaacgcccttttaagtgagaatattcccgttttcaggcacgaaaggcgatgaaagcctacacgtatagtcgcgttgggcgacgccaatactgccgttaggcattataaacagtcacgaatagggttgtcagtagtcgtgaataggcatcgtaacccggttagaacccagtcgtaaccctatcggatagcccgaagaagtcaatggatatgaattaggatgaattattttcgctagaatgaaaggcggtttttcggtattgtattatcaatgaacgaattattgtttttttcttgcgtatttggcaacgagtcgtacatagtcccggaaaaatcggttctccgggacttcagtttacaaaatgtcagaatgtcaaatcgccaaacggtcttatcacaaggccttcatcttcaagaaatgcttccagaaaaagaggatctggtaatcaatagaattattccagtattgtgaatcatgattacccgggcgagtgataaagtcgtggtcgatgccttgttttaataacgcctcgtggtagttcttattcacctccaaaaagaaatcgctgtcaccgcaatcgaagatcaaagcgatctggtctttcctcaaggttggaaccaaattgataaccgtgtacttctcccagttttccggatattttgccttctcacctatttgtacgctcatctcccagtttttcgggaaagggcggatatccacgccaccgctagtacttcccgcagcggagaaaacatcgctatgacgaaggccattccacatagcgccatgtccacccatgctcaagccggtaatagcacgtcccttacgatcggccacggtcttataatgggaatccacgtatttcaccaactcatccgagatgaaagtctcataccgtacatcagcgttcaaagggctatcccaataccacgtattcttaccatccgggcatacgaaaaagatacccttctcatcagcgatcttagatagatccggcttgataccgacccatgtacgagcgttaccgccatagccatgtaacaaataaatcaccggacacgctttcgtcgcagccacatccggacttaccacgactacctctatacttttattcatcgaaggacttttcacttgcaaagtatctaccttcgccgcctgtaaaccgagcggaagcaaacaaaccaacgctaccgctacctttttcatccaattcatatcagtgaacattaatgattaattccccgtagccttgttttcaaggaactacggggacaaatatacagattttacagccaaaaacttatttacttaacgagaaaggacgatcctctttcgcggttcctctcgtcttctccggttgattgcccatttgaagctccagcacgcccccattcacgatatcgctgtaatggatataattacgtgtatgtctcttcccgttcaaggtagcgttttggatatatacgttatccttactattccctttcgcctcgatcacgaacttcttgccatcctccatcgtaatcgtagttttccggaatttcgggctacccaatacatactcatccgtccccgggcaaacactgtagattcccaacgcgctcaatacgtaccaagaagacataccgccttgatcctcatcacccggataaccattttccgagctattatataaccgatccatcacctgacgaatccaatattgcgtcttccaaggctggcctgcgtaactatacaagtaaatcatatgctggatcggttgattaccttgggcgtactgtcccatcttcgccaattccatctccagcatctcatgaattttcgttccgtatgttccatatttcacgataccgggtaaagcgaaaacagagtcgatcttcgccacgaaacgctcatcacctcctgtcaaatcgatcaacccttggacatcatggaaaaccgaccaattgtaatgccaagcattcccctcgcaataaggaccgccccattcgaaagcatcgaaatccgcccaactaccatccaatttacgacctctcataaaaccgacagatggatcgtacacattcttgtaattataaatctggcgggcaaagacctcctcataaaacttattcccagtcattttcgccaactgatacgcacaaaagtcatcatagcaatattccaacgtctgtgccgtagatcccatggattccggataaggtatatatcccaactgataataatccttccaacgaacccgtccgttggcaccgccccaaggtcccttattcatcgcctcatgcgcatacgctttcaaggctttctccggatcgaaagtgcggatacccttcacccaagcatccgtcaataaagagatcgagtgattccctaccatcccgccggtctcactcgggaacgaccaagaaggtaaccatccacattgctcctgagcgtctagcaaggcttgcatatattgcccctgcatcgtagggtgcaagatattggtcagcgggaactgggaacggaaagtgtcccaaaaaccattatcggtaaacatatatccatcatgaatcttctcatcgtacggactatagtagtaaggagaaccatcctctttctcctcataaaacttatgggaaaacaaattggcacggaacatgcaggagtagaaggttttcatatcctcctcggttccaccttccaccaacacacgattcaatagctggttccatacatcagcagccgcttgcttcgtcacttctaccgatgagtgcttacctagctcacgagtcatcgtaacctccgcttgctccggactgatataagaggtagagaccttggcctgtaccttagagcctttcgcaaattgtacataggcaccgataccttccccttcccgcctcaaattattcttctggatcgtattcttacgattctcccatgtaccatagctaacgaaaggtttatcaaattgaatgataaaataattcttatgtgtcttcggagagaaagccccattgtgtacatagccggtgatccggtggttcgctacatcgatttgtacctgactggttttcgtatagccatccagtacgagaaaagcgtctcccttcgcgggaaaggaaaaacggaaatgagcggaacgggtagttggcgagaactccgtggtaataccattctccaacgtaaccttataataatgaggcttggcaatttccttatcatgagagaacggagtcgcccgtttggactcatcaacaaccaattccggtacaggcatcaaagagaataccccgtaatctcccacccaagggctacattgatgcgtcggttggaaaccccggatcgtagtggccgagtattggtatttccaaccatcaccattcttcccggtctgtggagaccagctattcatgggatagggaaccgccgtagtcgggtaggtatttccccaactcaattcgtaagtcgagtttgttccttgcaaagtatttacgtattgtaccaagtctttctccgcaaaaacagggaaagagagggttaaacagagggctaaagccgccccctgtttataaaaagtattgagtttcatgttattttatttactgattaattattcacgccccaatttgtattcggctcggggcccatctccaattctagtacgccacctttcatgatatccctataatcaagatagcatctcgtataatccgtcccgtttaatttagcggattggatataggtgttttccggggtatttcggttggctcgtatgataaatgtattcccttcgccaacctgaatctcagtcttctcaaaaaccgggctggatatctcatagcgagtatctcccggacaaaccggatacaaaccacatgccgccaatacataccaagcggacatctgaccgacatcctcgtttccaaccaagccttctaccttattcttatacgccttatcgcaaatgaaacgagaccatttctgggttttccacggctgtcccaaatgattatacaagaaaggcacatgatgaaccggctcgttcgcatgattgtaataagcgttccacaggaaatctgttggtgtcttgtcgaacatcgtatccagatcggcgatcacccgttccgttcctcccatcagttccaccatacccggaatatcatgaggcacaaaccacccctgttgcagctcattgcattccatacagccgtaccattccttcagcttaccctcttccggccaagcctcaaaccggccattcgcttctctcgggcggaagctatgtttctccgcatcatataaattccggtaagactgagccaacttcgcataataaaccgcatcctcctgttttcctaatgatttcgccaactgagacatacaccattccgtatacgcatactccaaggttttggagatactctgcggattcggggtatagcccaactccgcattcccgaacattctcgaggttttatccgcataccgataagccttttccatatccaagctacaaatacctttcgcataggcatccgccaagaccgatatagccggatttcctaacatacaaccgctataggcgttcaacaactcccagcgctcatagtactcacggccactctcctctgccatcgttgtcaatgacttcaacaaatcgttcaccaataccggattaataatcgtttgcaaaggcatctgactacggaacacgtcccaaccgctaaagatcgtacgtttcgtgaacgtatccgacttatgcgcttttccgtccgcgcccatatattgaccatccacatccgtgtaaatcctcggatcgatcattgtatgatacaaggaggtatagaagatcaccttctgctcatccgttccaccgctgacatccatcttagccaaagccgtatcccataacgagcgggcacgagaacgtaccgcatcaaaatcccaatccttgatctccgctttcaagttcttttccgcaccctccaagcttacaaaggaaataccagccttgaaaagaacctcctcattcgcctcagtctcaaactccgtaaagaacccgaggtgctcgccctcatatgcctttggtctctccgaaatctttgcgttcgctgtcaatatctggaaagccggactctccacgaattcccgatgccgatcctgccctgccgggatatccacgctccatacaccataatctttcaacggtttggaaaactgcgcataaaaatacacggtgtatcgggaagaaccttcaccattcccccagcctccaccttccggcgtacattccattcgtccggcgatcgtatggtcatctatcacttgaaccgcctgatacgtagaagtacctcctacacgacgggctaagtccaactggatgcgggactgcttattctcggggaaaacgaatctcagcataccgctatgaggagccgctgtcgcctccgcttgtatctggtaatcgctcagcaataccttataatatccagccttggcctcctcggaagatttatcataccgggaacgatacccggctacgcccccctcttttcctgagttcgtgcgcagatcgcccacggtaggcattaccaataaattacccagatcaccataccagccgataccactcatctgcgtaaaagcgaatccctcgatcgtctcatgctcgtagctatatccggaaccattgtcgccccccgtaatcgtattcggacttacctgtaccataccgaaaggggtagtcgcaccggggaaggtcttccccaagccatggtaagcaccggccgcctccgtattcgtactcgccccgataaagggatttacataatcagagaaatgaacctcctcgatagtccgggtcggaccggaacaggcagttcccaccaacgcaagcgataacgccgtggtcgttatccatcttaaatttcttactagtcgtatcatttttttataagttctattctacgtaccttcggttgggcgatctgatacatacgatccaccaacatatcgatttgttggctccaagcctcccggatctccggatacatcatcttggagtagttatccagatggccggccaagaagatattcgtatgaaggttcgcccttaacgtatccatagcggcgatattatcctgaaataacatgcccttccgcttcaagatataaaattccgtccacgcatattccctaaaacgtttctcgatattccaacgttcctcattcaaatgcatgacccgaacggcctgctgatattgcggtgtgttcgttaacgccgctaagttaataccttttgccaaatcctcggccgaaaacgtagaaattgaatccccgtctatctccaacctatacgaacctttcaatccatccacccgcaatacctcttgattaagatcctccataatcggagcgtacaaggtcgcctcatattgcgtatgcttcttctcccaaccccgagagatcgtatccatcggataaggtaaagacttcgctaaataggtaaaagagatcgtacccttgtctgatactttcaattcattcacgaaacaattctcgttcgccaacaccatacgtcgggaagcatcgatatcaactttggcgaccggtttacccgccaatccctgagacttcaagaagaaataggccatcaacatattaccgtggttatccggatgaatccgatctccttgcattaaggtaaaccgcggatctttcgcttgttgtaccctgttcacctctaataccgggttgtggaaatccacgaacgcccagtcattcttcacggccgcctctctttgcagacggatgattttctggatcgtagcgttctttccaagaaaaggcttatttttctcattttgccaagtctcgtcgtacggcgtgccaccgatcatgatcacccttgtatctttgtgagatttcatgatcttctgcatcgcctgaaaggtcgtatctacccgatacatttgccgctccacgaaagccgtaggattatcgccgttatattcgaaataaccactatcgttcataccgaaagtagccgtaaccaccgtcggatttttaccatatacatcctcctcgatccgttccaacatatcccaagaactgtcaccaccggtaccggcgctatacatccgcatccgcatatccgggaaatgagtgatatagtacaaccatatataagaatgataatgtccgccctctgttatgctattgcctaaaaaaacaacccggtcacccctttgaaaaggggaaggagttttctgcgcattgccacacacaaacacagaaagcatacacgccaaactaaaaagccatcgattagttctcatcttatttacttttggacacttagaagttcaattgtttatccgatacggccacagccacgaatgaatcggcacagccataatacagataccatttattccggtaatagaccagaccttccacgaatacggtacccgcagggtattgaccgcttttttcaaaatcatccgtcggttgcaagaaaggcttatccaaacgaccgatcaattttgtcgggttatttacatcgaacaatgcttgtccggcacaataagagttcgcaggataagcggtatcccctttttctcccggttcgtttttaccgttatacaacagaacgatgccatcctttgtcaagatagcgggaggtccacattcggtcaactggctatcaaaatagccggaacggggagagaacaatttaagcaactcaccattctcgtccaacagtgggtcccaatctgttaaattatcggaggtagccgcatatacattcttctccccccagtacatgaaatacttgccattcactttcgcaatgacctgcttatctccctttaaagtcgtgactaacgatgcggatttggtcgcctcatccttgaatttgccattataggctttctcaaaagccggaccgaacttcgtccagtgtttcaaatcctttgaggtcgccaccgccagacgaggcaccttgcggttccattgcgtatatagcaagacatacgtaccatcctcggtcatagcaatacgaggatcttccgtacctccgggacattcgttctctacttgattatctttagccggataaaaagcaggcttcgtatccctctcgaaatggataccgtcagtagaggtcgcatatcccaaacgggaagtccgggaaccgattccctgagcggagttatcttccgcacggtacatcaccacaatcttcccatcgtaaatcgtagccgccggattaaatgtgtcactctcctcccatgctacagaatcttcccgcatcgggcaataaaacttagttggtaacggcttaattaccggattcactcctgtcggacgctcaaacccgtccaagcaccaagctgtttccgatacagcttccgccgtctggtctttcttttgagagccgcaagctacggtaaccaatcccaataagccgaaagtagagactaataatgtttctttaatcatgttattcgtagtattaagttatatttattttccatatgaagggggagctatccgagttccccacgtcttatccggcttcccggataatttatattccaaggtcgccccccgatataaatccgaccaatcgatccaagtgccctccatcttctttccatcaagacttaaggaatggatatactcttttttctcatctccccccttgataatcacgtctccctcgggcaaatgtaaaacaatcttacggaataccggactattcacagagaaacctcccactccgggaatctctggaaacaaaccgatactggcaaagacataccatgctcccatcgatcctaaatcgtcgttgcccggcaaaccgttcacacggctactatattgttcgttcagtatacgccggatcacttgttgcgccttataaggagcccccgcccaattataaatccaagggatttggaaactaggctcgttaccggaggcgaaccattcatctccataactagcgtccaaacgtcggaacatctcatccaaacgcttctccgccgcttcctttcctcctatactatcgatcaacccttgcaaatcataaggtaccatccagaaataattcttatatgtcgattcccgccaatccgcatcataacgtttccacgagccatcctcgtttcgggactgcaaccaaccggtctccttattaaaaagattcttccagttcatcgcccgttgcgtataccaattacaaaccggctcatcattgcaggcttgcaaggcgaaacggccaatcgcaaaatcagaagatgtatattccagtaagatcgaagcgtcgtaataccctttctccaaatactgttccaagcccggtcgagtcaaaacaccttgggaattagcccccggcacttctgctccataacgcatagtccgcagtaaagttcgaggatcataggtgcgagctccaaacgcatacgcattggctacaagaatcggagtcgggtccccctgcataacacctgtctctatattcgccagtacccaacgggggaagccaccaccggattgctcggcaaataagtaatgagacataacgatatccgaggtctcctcgggagctagcatagcgatcaaagcagtctgcgtacgatacgtatcccaattactgaaagaggtatagaattttcgggctgtcttatgcacttggctatccgcccccatatattccccattcacgtcgctacaaacattcggatggattaatgaacgatatagatgcgtatagaattgcatctggcgatcctcgttatctccctctacctctatcttcccgaggtattcattccatttatcttgcgtcgcctgacggaccgcagagaagtcccaagcgggattctcaaccctcaaattctctcgggcattctccaccgagacataagaaacaccgatcttatactgcaccgcctgattcccctctttcaacggaaaagtaaaatacacccccgagtgactgccttccgcaaacgtatgattcgcatgtagtcgctcctccttccatgtaccaaaactctccgcatccgcatcgaactcagccacaaagtaaaccttatagggagttgggattccacagaaagcaccaccctccgcatatccctcgcaactatgaggacccgtaatcttaatagcggctacttggataggggtagcggctactcctcctccgataatcacggtaccctgcttttccttggaagaaaacgtataacgagccatacccgtacgttccgtaacggttaattccgcacgtatagaatgatctacggtggctgcgtaataaccggccgttccgatctccttgccgaccggagtctgcatattcaagatactatccggagaaacccgtaaagctccggcaatcggaagcgtagggaaatttcccatatgatcgcatcccgcaccactcaattgattgatgacaaagcctagttgtttcgtgaaataagtcggggtaaactgtaccataccgaagggataggtagcccccggatacaaatatccggaagcccacccattaccttgagtccctatcagggtattggtcttagaaacgagatttgacgcatttaccaaacctccacacaacaagaaaacatagctaaccacacatattcgccttaaaagctgtttacatttaaacatggtaatagatcctttttattatttagccttttatactatatacccttcaatagaataaaacacttacggcgtaataattaaaaaacagctattaacataagtcaacaaaaagggaatcatatgattcctattccgcaggcagcgatagcgtgtgttttccactttccaacaggatcgaacccgccgatatttctacattattcccatctaacacacaattcgatacgttaaatggagcgataaaggtcgccatactattcgccggtatctccagatcgagggaaagcgatcggttctccatagtccaagacacacgtgccgtaccgtaaggggtctctctcgccgccctcgcccacgtcacgccattcggtatctgaggtttgataaagaaatgtttatagcccggctcatcctcatccggcaagatccctccgaccgcctgacagaaccaagcgccaatgccattgaaacaattatgaaccttactacgttctcccgaccagtattcccaagtcgtagaagccccttgatcgatcatatatagatatcccggcagctctctctttttcagcatggaatagagaaaatcggcctctccgtcctttatcgcccaatcggtcaagattgtaacacccaccaagccggaaccgatatgccctttgcaattctccaatgtctctcgatataaaccttcctttacctcgggcatatgctgttcatctgtcacgccgaccaacatcggataaatccgatcgatctgggagcctgtagcgtactgtttcttctccggatcatagaaagtcttctggataagctcgttcaatcgttggcgacgctctttatacttagcggcatcctccgctttccccaataccttcgcgatcttctccatcgtagtgaggcaatcgcttataaagcagttactaaccagatctaccgatgactgcgccgtataatcgacacccgccggagccaaccaatcccctaaataccatgcccgataatccgtatccggccaacgtttcagcaatccatcgaccgtatacgcatccacataacgcaaccaatgtcgcataaccggataatatcgctcgatcagacggctatccccataattcaaataagtctgccacgatcccgtgataataaagccacaccaatacggaccacctcccgccgggtatggactcggtacgcaatgcggcatacccccatcctcacggatgcaatcctgccacatctgcatccagttcatatacacggaagagccctcatacaatgtctggaaactcttacaagaggcatttccatccccaccgtatcccatacgctcataatgcgggcagtctacgatataaccactgaaagctaggttcttgaaagtatatttgatcatcgcatagatagcattcaagtccggatccgagcactcgaaagacgaggcatccttataatccgtatgaatcagatagccggttacctcctcgggggctttcgccaaaccggatatccttatatattgaaacgcatggtggttaaatttatttcggaatacctctttgccttgtccggaaccgatataccaatcctcatactgtccgttctcctcttgtggcttgaaatcttcgttttcatttaaccaatccgtatattccatacggacccggtggccttccggtaattttgggaaactcagctcaacccaaccatttaacgcctttcccatatctacgagccaaatactatcccctatttgtttgattcctttgggacggataatctcttgtattcgattaggctcacacatttggggacttacctctatcccgggtacctccacctccaataccggcgtccaatccagtttgtcaagcgtagccgttgtcaaatccggcaacgccttccgcccatccacacattcacccccgaattgatggggataccaagtaccggtaccggtctcaccatacatacttccccggccttcccaagagctatctgtaacgagtaacgtacttgtagcgccatttctttgaatctcgtccaattgcagtttaaccaacggcccatcatgaacggcattaaaagtagcttttctgtaccagccacggcccaaccagagcaataagtcgtttattccctgctttgcgtacggcgtaagatcgtacgtcaccgataatgatcttttgtttaattgagataccgcaggcgagagaacatcttccgataccttcctcccatttaaatagatctcatgataccctaaggagtttacatgaaggagtaatgtggcatcacggtcttgaagctcgaacttattccttaacatcggattcttctcatccggcatccctatatatttcccttgccattccgctttatccaaaagcccgatcccaaagcgattgattggactccaatccgaggattcccccttatcgtcccatacccggactttccaataggccagcacactagatcgcaactctttccctcgataagggaccatcacggaagcggacgattccaccttacctgaattccatagatcggctttgccttgagccagcaaggaactatccgtggctacttgtatctcaaaatacgcttgccgcatagtttgcccgtctgtctcgattttccagctaaaatggggatgggtattgtcgatcgcaaccggattctccaagttctcacaacgaagatcttttaagatgaacctccgcccggattcacagcccgacatcagtaacaatagggtcacaaagtagatagatatacatttcatgataaatagattgagattacgcatgaatatactttctaatggcttacgatacttatatccccggtaaatattaagatttattaaacaagaaaggcgagccactcgcaaatgactcgccttcctacgattcctcaagaatggctagaagcggatcttgtaggattgattttcgatacggatgatataggcaccttgcggaatggttatcatcgtctcaccaattggcaaggttaaagccttatatagttgaccgccgaatgtcactagataagccgtacccgcatgagcggaccggatatgcaataccccgttcgatccccagactttcaagtcattggattcgagttcggcattgcctacggtggcgttttttatgattccggtgatagagatcgtaatgtcggacgcgatacccttgatctcgtatttaccgtcagaggtcggctcaatcaccttatcacctactttcacgataggggtagattgatcgtagtccgcttccagcgtaagagagaaagagaagctgccaccctcttccacggagtaggttccggcggaaggattcaacgaggcaccttcaacggatggaagaacgacgctgaatgtcactaccggatccggttcggaagagactgcggttactttcgatagggtggtcaaagtcgtagcgatctggtcgctcaccttacacgtgattacgcaacggtacgtacccacctcgggagcctctaccttataagaatcagccaacggctcggcagcacgtaagagagacaaggatatcgcttgaggtgctggggtctttgtcgttgtcttcttatcaatccatgtaccattctctaatctctgccattggaaaatcaccgaggtataagattcgccggggacagcggtagccatcaagtcaatggaggagccttcttccacggtcttatctccgatcggagcgatcgcgagagctcccgtgccgctaacttctgagatcaagccgacactatctgcgaatatacccgcattctcaaccgtagtattgactagcttggcttgttcatcggccgacgacaagatcagtacgccctcattcttgatctcacctaaccggttcgtgccggagagagccagttccgctttcgcctccggggtaacagtcagcgtaggagctgtcacgttcgtcaattgaatggtagcggtatctttagcggcagtctcatttgatatcatgatatcccctactatcgcgttctctattacagaatcctgttgattgatcctgagagagtctagcattacggcttccgccacgatcttcagatccgtgaggacagatggcacggacaaggtacccttggccttgtcatacgtatatccctttacgtttacctcaacactatcgggcagttcgtaaccctccagcgccagtaaggtaaggttcagcgtactatttctctggatggatttgacggtatccgccaatgagatgttcttcaagtcgtatgttatcgtataagaatccttgatactgggatcgtattcctctatgttcttgaatttaccccagaaatcattattcttatagacatccaagcagccttccgggaccaatatcttacaagtcaaggtatctacgcttttaagcgtttcgacatcaattcccggcattaacggtgacgagagttttattgtccgtaaattgacgcaattccttattgacgaacccatacctttcactgaggccggcaccgtcaacgaatccaaggaactcccgaaagaatgctgtatcttcgtcaccgcataatctattccccccacggtaaggagagaagggataatggcattacttccccctttatagttagaaagcgtagcttccgcattggccttatctaactcataggtattgactccctctttatattcctcatatccatctattgttatttgcagatcaccaaacaacgctggtacttgaatcttttgttcttggtcattaattttcagaaagtccggtctacaatactctcctgtctctatagatctacaacttacgctaaaccgaagcggcgttccatctttgcttcgaacggttacatttacgtcctctccgtattttactgattccggcccatcaaaacttacattcttagattgataagtaatcttcaaatcattggatggagctactccctcatcagactcagagatattagcctcttgtaccggaagacctgaataagccttataaaccttaccggcccccttaggaacaataattttcaagttatccttgtcaacaacatcaaacaaataacttgctataccaacaggaatatatcctttaaatgtgatggaagccagggacttcgggagcacattattaaaatacataaactccttgaccctatatttagagccaccaaacgtcacagagtccggcacaatcagattcttggttgtactcgggacatcgtttatacaggctgttttgccatcacgatcaagactgtaggcatatcctcctatcacagctttaccatatcctgtgacatgtataactacatcccctgtcacattggatatcttgtagaacttaggttccttcttatcttcctccaaatgcccctgtgaattttccatagagacactatagttcataggattcccatacgattcgtatttaggttttaacctaaaggtgaacgtctcgccatgtccaacctccgccggaccttccacaagctccatgttcttaagatcataggtgatcttgtgcatcacttttgcgttctcttgcccactggcaatccacgttccactacataagaaagccatcaccaacagtgacagtcttaaactaattttttgtaaatctagtttcataagctaatatttataatgaacaatcgttttaacattcgttcacgggtatgctcatagcttcccgtctatgaccggtgagagagcctaggccatgaaccatgagagagcctcgtctatgaggggtgagagcctaggctttatcagccctcatagatgaggctctctgccttatcagatctcgtccggactctcgctatcgcctccgcctccgatacctaccgtcaagaggatggggaacttataggtacgcgggtctttcaccaagccgtaattcgcccccgcctgcgtagtgacgctcagccagtactgcccctcggcgagttgcgggatctggataattatctcgctcttggtgttacgcacgatgagggagaccttcacgggcgtggcgccctcctcgtccttggtgaagtagatgcctacagatggatcatcccccttgataagcagtgtgctgccgaagatgatagccggagcgtttggagtgatatggaggttcttctcgttcgtggtagaatccgtgaggctctcgatcatcgggcccacggtagctacgtcggcgttcacgtagatgttttctagcgccttcaggagggtggcgctgggggtgaacattacggtgatcttattctccgtagagcggaagtctgatttctttccgtcgaacgagccgttgatagtgagcagccattgcccgaacttgttcaccacgcaacggccttgggcgagggcctcgatcatctcgtcgtaggagaggtcgaggatgttggtgatcgtctccggacgatactcggtacgtttcttcacgatgcggttcgagatgtctgaggttcgcgtggttccggtaatgcggatctttccggtgaaatcgccggttttctcggttaacacgttgtcgtacagatctacggtcaagatggtcttttcttctgccatgatgttttttgtctttaatgccccgtggtagtggggcgttaccttttaataatgtttatcacccttattcgcgaaataaggggaggagatatcgcacgtccaacataaactaaaaaaacacgcataaccactatttttaaccgcatatccacgatatatgcgcaataagcataaatttggattaattagaggatacgatatctgtatccccttcaattcctatttcttaataaatagataaaagtgattgtttatcaataatattttttacatttgccaagccttccgttgaaaatagcctattataggtaatttttatgctgaataggctcttccccttatttcgcgaataagggcatcatccagccgccaaaagcaaatccacctcttccgtcaccctagcgttcgcacgattcaattccgactgttccaaagaggccagataaaaacgtgttgttttttccgaggtatgccccagcgcttggctaatgatcgataaagggacttgtttccgcaaggcgttcgttgcccatgtatggcggaaaacatacgaggtcagatgaatggggcgagatagcgcacgaccgatcttcttcaacgagttattatacgaacgcagtatcgccttgtattcctcatgccctacctctctacccggagataaaatagggaaaaggtacggggaagaagcgtccgcatacttattaatcaaccgccgcatccccgctgttatcccgacacggattaaggtccccgtcttcttacgccgatatacgatttcctcgccatacagattcgccgtagtcaagcgagccatatccgcgaaaggcatgccgcaagataaataggcgaacgtacaatagtcgatcacgcacgccaaatccggctcctcagacttcaaggtcacgatctcccggagcgactcgtttcccaacgccctagatccggctctttcccgcttcaagttcaagtacgcgaaaggcgatacgacgcaagccggcaacagaccatcccgacaagcttggttataaatcgagcgaaagttgctgaggtatgtattcacggtattcactcgcaagccggcggattgcagataagcgacaaaacggcttattaagcccggggttatctccgggaaaaaaaggtttctcctacccagaaaggcgcagatccaattacgggtcgtcctatataaatcggcagtgttatgtttccccgctaaacgtttctcccggatgcgttcggtggcataggtataaaatgtgatgcccgccttgcccaagcggttattctttctcttgctcatatctccttttttgatgattaaacgtattattatctaccatcaaaaatagcataaaaacaagatcaagccaagtccatctcgcaaacagcaagcttccaacccttaaagaccaaggtgacaagacgaagctccgtatcccccttggtagcgtgaaccttcgggtcagcggcgtaacggcgtaactggatggcagcctcggctctcaacgcctcgatttccgtttcggaagcgtcccaacgggcgtatttcacctccacgatatagctaaagcctatctcgggctggtggatcaagtcgggcatcatgtagaaatcggcgtaccccttgttggcctcatactccggataaattatataggtacgggtcaagcctagataagccagtaggaaacctttcacgtgcgcctccccctctatgaactcgcggatagcgctctgccgctccagctcggaggaaaaatactcgaacacaggcttccagtctccgtcgtaagccatgtcctttaccagatcatgaagcttgtataactctattgagaagacatcagcttcccggtaagcctcgatcagataggtatataattgctcacgtaccgtcaggttgggaacgcccagaagggtatctccacgcttggtacccttgatggagagcaacccgaaatagtaaagcaggctcttgaagttgtccggcttggcgatatcctcggcaggaaaagcatccttgattactgcggtggtctcgccgttgttcacgatctcctggatgatcgaagcgttcgtgccgaaccgcttgtcgagacggatcaaatggcggagcttgttgtagtccgtgcggatgttgttgtcgatcatcttatccggggccgatctcaagggcaggtaattgctgatgaaatacagtaccatatccgagttgtacataggctcgtccagactcttcgtagagaaacggtagttatcgtaccacggcttcatcaagttgatcagatcgtccacactatcctcaaaacctgtctcgctcttgtaataggccagcatctcccgtacctctccctcgctaaaacctatgattccattaaagcggtaatctgtcgtcatgttggctccgatattgaaaccgctggtcacgtcgtccatcgtcactggagataccccggtgataaacatgcgcttgatagggccatcgcccgtagccccttctttcagtttgttgaagaaataacggaagaagcccgtaccgtgtgtcaatgccttgtaatgtttctcacccatattggcgaggatagcgttggtgaagttatcatactcgtcaatgaagagatagatagagagattcaagcgtttagcctcactgatcgtgtaggtcaacttctcgtcagcatttggcagactctccattttctcccggaagcccggattgaagaaacgttcgtagtagtaggcaaactcccggaaacgagcggcacagtgatcattaaaagagcggatcaactcgtcaggatctgggttcacgcctgcgaaattgaaatccagtacaagatattgtccctgctccggggtcggatgggagccgatatataagtcgccgaagagttcctcaaaagaatccttacggttcacgtcataataccatctgaggacattcaagaatagcgacttcccgaaacggcgcgggcggataaggaaaaagaaacttgcgttccgctccacctccgcaatatagcgagtcttatcaacataataataattggcggtacggattcgctcgaaatccgtcaggccatatggaatttgcttcgttgccataatatatctcctcctgtttatttgtcgcttacgaataaatcacttgttcgtaacttacttacgcaaagataacatctacaaaatgatttcacgaatctttgaccgtagaatcatgccgtcaaaccaaatcaatcgacaaactcaccagaaggaggattcgcaccttctcccactccccacttcttattagggcggtctcccataaacaattctaatgttcctcccttcatgacatcctcatgagtaaaccacgtcttattatactcggcgccattcaacttagcggattgaatgtatttattttcccacgaaaccccatgagcgatcatggtaaacactttcccgttcgccaactgaatctccgatttatcaaataaaggactacctatcgtataaacaggcactcccggagaaaccggatagaaacctaaagcggagaatacatagaaagccgacattccaccaccatcctcatcaccacaaacacccatcagatcattcctgaaccaactttccataagcatacgaatccgtttttgcgtcttccacggctgaccggcgtagttatacagataaggaatatggaaactaggctcatttcccatcacgaattgcccgacattgcccgtagcatccggatgaagagcataatattgccattttgacattttcatatcctcaacaaataactgatccaatctctcaataaaaggagtgttgcctccaaaaagatctattaaatcctgaatatgatggcgtacatcccaattataggtccaagcattattctcatcaaaataagccctagccccgatacctccggaaaaaatatagtcgaacggttctataaacttcccatctttatccttcggatggaagaaatgagtctctttgttaaagacattccggtaattataagaacgatcctgaaagaatcgataatcctcatcttttcccaaatgtttagctaattgggcgatacaccaatcgtcataggatgcggctgtagttacggctgccgcttgtcgctgttcaaatggtcctacctccgtaaactcttctttttctcccggatgcaaagcggggaaccagccattctcatgataaaaatcatccaaggccgttttaggtccccggtaccaagggatcatggactctgtcatcaccgtatgcttcataccctcgaaagccttttccacatcaaaccgcaagcctttatttaaggcatccgcaaagacacctgccgcatggttaccgttcatgcaatgcgcatccccaaatacacaagggaaagtaggtatccacccggattgctcatacatccggatataagacgccagtttttgttcttgagcctccggattcaataacacttgcaacgggtgaagggccagataggtatcccatacccaatcatccacccagaaatccaccccattatcttcatgtacctttccgtcatacgcactaaaatatttaccatcttcagaaatattgatcattctttcgtgcgcccgatacaaggcggtataaaatgtggtcttttgatcctccgtgcctccttcaatctttattttgcctaacacgtcgttccatttatcacgagcttgcgaggccaatttctccagattgaaatcattgatttcattatataaattccgcttggcctgttctactccaatataagaaattccataacggacattcaccacatcctccgattccggaaattcagcaaataccaaagaatgagagaggctatcaacttgaatgggctgggcatcaaactccaaataaaaataatgttttatcccggcgaaattatcatatccacacaaagctccatcctttatatcgatctctccttttccattggctttcaacaaaatcaaccgtcgatccgaatcctcaaaccgaaaacgatagatcgccgatttagcagcaggcgcaaaatccacccctacggagaaatcatccaaatacaccgaataattataaggcgtagatttctcatgatcatatcgatattttaaattcccaccgaactccttaacgtcccccctataaggcaacagcaacaatgaatggccttgcctatgggaaggactatttagggccagtccctccatacgatccgtcgtaaactcattatgagtcggaatcattcgcaacatgctgttaggcaggtgggtagtgggataggtaggcacaagtaaatgactgatattcccaatccggttattcacataatctactggtgttttttctattttacttatgcaactacataataatagaaacaaggttgtctgaaataatagtttcttcatgagattgtatttaataataacgattctctagcatctattcttaccacaaagatgaaaattaaagttgatgaagcaaaactatcgtgagttattcaaagcagaactctctagagaattacatgccgtgttcccgtattatgactagaaaagaggctaccttcctttttgaactgcacctcttttctatctagaataaagtttatcaaaaggatacgggttgaatatgcatagcggcaccaccatctgaagcgagcggtactgttattttatcctttgcggtaacagttaaagtatctttgataagatgattaggattggtatctgtgtctctcacatctttataaagagttactttataatctcctttaccgagggctagcatatggcagcgagtactagtgacataagggttactttgttgtatcttaaacttgtctttcggaagagcccgaaacccgcctaaatgataatcggcagctccagccaataaacgggtaaaaggaaatgatgtttagctgcctttgccaagaactcttcctaaatacgtatcatatcttgatcgccattacgtaatttttgcactattaagcgctcccgaacatccatctcatcgcaaagattaggttttaaaatgaaaattaaaactgttatttctaataatacaatcttccatccacagctttttcatttaccgctccgtttaaatgaagcttcttgtaaatttttatatgtgctctggttttctgtggaaggattcgggacaaacacgtacgactttcatccaaaacacgtacatgttttttcaaaaagtcgtacgtgttttggatgaaagatcatcgtgcttttttgactctgatttttagcattttatacactagactcatcagtggtcttattgtacggaatttgtattgagaacaaagctttccggcttaacccaaacggatgggttgccatctcatatacgtgcctgtccgccataaccactccatcgggccgtagcgcaagccggacagccaatattggctaaaggcaatctgtatggccgtaaatccaaggcagaccaatacactcaagaaaacacccaaatggctccaatccaagccaaaaccggagaagataaagacaccggtcacggactgtacgatatagtttgtcaatcccatacgcccataactaaccaatggcttcatggcattttgaacttttaccgagcggtaagcctctaagaccaacaccacccacagataagccgtcatcagattaatcaagttagttgtcgtagcactcatccaagcgttggaacaagcggatccggcctacgataaatccgaggataaacaatcccaaggtcagatagatacgaccgctggcaaactggaaattcatttttccaaccaatccgtcccaagcgttgttctcaatggtctcggctaatgtcgggactcgccggggagcctcagcacgagcgataggtgcggcagccggtctctccaccacttgctcgacggcaggagccgttacagccttatacgctacgggaattagcgaggcaccgcccaagaaaaggaaaagggtgattcccaccaataatttagtaggccatttatacatcaataccaatacaaaaccaagcaacgcatacaccaacaaaatatctacacgaaccaataaaccatgaacaaaaccaatcacaagcaacaataccaatcgccataaaaaacgaggacggaaatcaacacctttttgagctgcccgatccatctggataaaaaagctcaaaccaaacaggcaagaaaatataatgaagaacttgccgaacaccaagtaattaataaaccaccgaaaaatctcatccagcgtcccttcccaagggaacatggcttggggagccatcgtccccatagcgccaaaatgctgcatcccatgaatcaagcaaataccaatcaaggagaagccacgcagagcgtcgattaccgtaatacgtccaccggacgaagcaagtgtcttattcatttccatatccgtaataatttttattcttattcgttttttcaagtttgataacgcaaaagtaaatggtggcactaaacgccgcaatactttcaaactccaaaacgaaaacaataagcctcatcacgaaaagaactaatttacggtaagataagcaattatagtcccaacggccaaaatagcgccgattgcggtctcataaggaatcagcctcaaccgctcacgaatgcttatatccgctaccccaccagtagcgtggaagaacgatccatgcggcaaatgatcaagcacggtagcaccggaattaatcatagcggctccccagacaccactgataccggcagcgataataatatccgcgaatgacgaagaggcaactgtcgctccggctgtagtagaggctgtagcggcagacatcaatacgccggaaaccggagccaataaaatctctcccatatccgtatgcgataacgcatctaataaaacatccttgatagaggaagccttgatcactcccgctatagtgcctgtcccgaccaacaggatcgagacattcgacatcttcttgagcccatacgagagactgtccgtaatcaatgaccatttcctcatcgccagaatcccaacgattcctccaacgggcaaggctatcatcggatcgatcgccacatggaataaagggcgaaacgacagcagtaggatcgtcactaccggagcgaccatgctagaggcgaaggaggggagagccgcttgcaggttatctatctcctcgttcgcataaaatccattttgccggggtaagaaacggcctatgacatataccgtaaacaacaatccaaccaacgccgggatcaagttcgcatacatgacagagtacaaatccgcatgaaaattctcagcggcgataatcgtattcggatttggagaaatgatattgccacattttcctccaccgatcatcatcaacaaaaggctaccccggggaaccgccagtttccggccgatactcaacgcaatcggagccaccgtaataacagcaacatcaataaacactccaatagccgttagcaacatcgtagcgaaagcgagcgcaaaaaacacatgtcgttctcccaatctataaatgatcgtattggagatagaagccgccgcacctgttttcaccaatatccccgacaatacccccgccgtcaagatccgaatgacagccggagttacgtcatttactccactgatcattaaagagaccgtttccggcaacgagactccccctaataatcctcctactaatgcccctaaaataaggctatagactggcgacacctttcttataatcaagaaaatcgacactaataatccgataaaagctccccatgcactcattatacccatgtgttagtgattcatatagtaatggattacacgcaattgttgttccaaggcacgcccaatattccggcaggtgaaatccttatccatcgcctgctccaaggaaaccggataaggaagaagtggtaagaccgccagaaacccggatttattaagtgcctctacctcctctacggaaccacccattacgataaccgggatatcctgtctcacacctgcctgcaacactccgaatggggtctttcccatgcaagtctgtttatccagtttaccttctcccgtaataattagatccgccccccgtatacattcatcaaaacgcaaggcatctagaaccatccggataccgggtttaagttcagcctttaggaaagcgacaaatcctccacctaaaccacctgcggctcccgcacccggaatgtcgtctatctctattcgtcccgttctttttatgacttccgcaaaatttcgcaagccctcatccagcaaacggaccatagcatcgtccgctcccttttggcgggcaaagacatacgccgcccctttctcaccataaaaagggttattcacatcgcaggctatggtaaatgaagtttcccgcaattgcgataatgcccttgaacaatcgatctcataaatccgattaaggatctgcccacccaattccagctcattcccgtctctatcaagaaaacgaaaacccaaggcctgcaacataccggttcctccgtcattcgtcgcgcttccccctattcctattaagaaattccggcagccacgctccatagcgtcttttatcaactctccggttccatatgtcgttgttctcaagggattacgctccgacacaggcactaacgtaaggccactcgctgtcgccatctcgataaccgccgtacgattatcccccagtatcccataagtagcctcgaccggcctcatcaacggatcatgtacgacacaagatacgacttctccacccatcgccgtaatcaaagtctccacggtaccttctcccccatccccaaccgggattttcacgacctcgcaatccggaaagaccttatggatcgccaactcggcacattcagccacttcaatagaagatactgagcctttaaatgaatcggaagcaacaacgatttttttcatttaatctcctttttacacataataataaaataaatcaattccttcaagatgccccaatatatagattttaaatcaaatgaagtactacttacttgggtagagaagatatacttcattggcaaagtaagctatctcctgtgacaaaataagtatatctcctgcgacaaaaaaactaaaagtgacattttaatgcggttacccttcatagtctttcaagaatttgtctaatagtattcaaatttttatttttgcatttattataatacaattatatattatgaaacaaaaattgaacattactacattcttactgttttggtgcatcactgctttatggtctatcccacgtcccgaatatccccgtccacaatttgaacgcatggattgggtaaatttgaacggagaatggacttgctcattcgatttcggaggtaccggaatggaacgggagttctataaatcgaacggttttgaccaaaagatcacagtgcctttctgcccggaaagtaagttatccggcgtaaaatacacggatttcattcaacatttctggtatcagcgtcctatcacgatcccacaagaatggaatggaaagaatataagacttaactttggagctgtttattataaatcggaaatatacattgatggagtcttagccaatcgccattttggcggaacctcttctttcgcagtagatatcacctccttggtaacaccaggaaagacacatagcctagtcgtatatgtagaaagtgacctacgaagcgcaaaacaaccggcaggaaaacaaaacctacaatttgaatcctacgcctgtaattatacccggaccacaggtatttggcaaacggtttggatggaggctgtccatccggaaggattgcaatccgtgcagttgctgacagatatagaccaacaacaattggttgtgcgtcctcgtttctataaagaactaggaggtaaattgcaagtaaccgtaaaagacaacggtaaaatagtagccagccaaaccattacggcaagctccttatcttctgctattctacccatcaagaaaatgaaaacatggagtccggaaaacccttttctgtacgacttggaatacaaagtaatagataagaacgggaaggtagtagatgaggtaagaagctatacaggtatgcgtaaggtacatatcgaaggcaataagatttatctgaacaacaaaccttattaccaacgcttggtacttgatcaaggattttatcccgatggaatttggacggctcctagcgacgaggcgttaaagcatgacatcgaactctccatggcggccggctttaatggtgcccgcctccatcagaaagtattcgaggaacgtttctattattgggcggataagatgggctatcttacatggggggaagcttccagttggggaatggattgcaatgatacggaaaccgcccggaatttcataactgaatggaccgaaatcgtagaacgtgaccgtaaccatccttcccttcttatctggacacctacaaacgaggagttctggcctgatcgcatacaatatccgcgcctgatgcacgacctgtataacctaacgaaaatgatagacccgacgcgtcctttccacggtaccagcggtggtgtacacatcgctaccgatatctggacaatccacaattacgagcaaaatccggaagaattgaaaaagcaactgtataatgacggtaaactatttgtcaccccaaaatgggaaatacaattgatgccgaaaaatatcggtttcaacggcctgaaatatacagaccaataccaattcccgaaatataaaaaagatatgccttatttagttgatgagtttggcggtataaaatggaacccgtcacaacagatggaaagtacccaaaatacatcttggggatatggagagcccccccattctttagaagagttttacaaacgtttggagggccaagttaacgctgtcctatctctttcgaaggatatctggggatattgctatacacagttgactgatgtggaacaagagcaaaacggtatctattattatgaccgtacgccaaaattcgacatgaagcgtattcatgatatcttcagccaaaccccgaaggtagaataacatcatgatcttagtacgagggacagtcaatatgtaacaaccaaattttatcagggacatatccacatggatacgtcccttaatttttacagattacatatttatctttatctcaaaaatttaataaataaaataaataaccttgataagtatctactttcgtttggttaattttgaatagcacaacattatttatcaacagattctcctcgaactccaccaccttctcagtaatgacctacggttccgtacaatctatgctctaagttttttcatattcatttgcaattatcaccagctcaaatattttaagacaaaagggaaaaatattagctctttacttacaaaataaaaaaacacggaactcatcaatgaatcccgtattctttaattatcaacattttagaggatatgctacttttttcttgtacatcttataacttcctgattgatgtacttaactttctccagatccatcttctccacctttcggtcataagtgaccaagccgtttatctcatgttccacatctgtagtctgcgtatagatggccgtgcttagtccgaaatagtttatcatctgctctagctcggtaagcattaatacataggtatcggtcaggacctctctattcaacatcatctcataagcgtcattgcgtacaggccacatatgcccacgcacaaatagaccttttcctccgaattcgccaagggacgcagcacgtttatcatcgggacgggggatcgccttaggctcgatcttgccataatgatgcatatccacgaaatctccatttctgggatctccataagccttacgatagcccggagcgtaattatatcccgacataccgtttacccaacgattcggatcgtactttttcacccaagctgtgatgtctgtcgcttcaaaagctccccaattctcattaaacgggacccacatcacgatagaaggcgagctgacgtgttggtcgatcatcactttcaattcgtcacggaactgtttacgaaccgccacggaatcctcaccatccggctcccaaagattcggcatatcttgccaaaccatcaagccaagcctgtcacaatgataataccaacgttgaggctctactttgatatgcttgcgtattacattaaaacccgcacgtttcgccagttctatatcatacaacaaagccttgtcggtaggagcagtaaatgcgccatcgggccaataaccttgatctaaaagaccgatatggaaaacaaactccccgttcaataaaggccgaagcacaccatctacctttcccatactaacagaacgcataccaaaataagaagatacctcatctattatctcaccctttcgatctttcaactgcaatttcaaaccatacaagaaaggatcatctggactccatagacggggttcccggataggcaagtaaaaactcatattggaatttccttcggttcttgccacctctgaagtaccattatccgcgatagccgttacctttaactccttatcctccgtataagcaattacttccaaccgattattttttaaatcgggcactagcttaatctgagaaatatattgtttctctaccggttcaagccaaacggtttgccagataccggaggtaaaaatataatctccacgtgagccgttcttgcccgaagcggcccggccgtcgttaggatcataagcacctaccacaaggacattttcaccggatttcaaataatcagtaatatttaaactaaaagcatcgtaccctcccgtatgggtacccaccttcttaccgttgacaaacacagacgagatccgatctacagccccaaaattcaacaatacatgcctgcccttccatgcttgaggaacagagaagctacgcttataccacagacaagtatcacccccacgagctataccggataattccgattccggaggatacggcacacgtatcttttctactttcgcgggaaaggctggaggagtggtcgccgtaacaggatcgagcaggtcttttcctcccatataatcatcgggtaagtcaagggcattactgcccccttctcccctaagaaccgtacgtgagagtttcccctcatacggctcaagcaactcaatatttctatttgttgttagaaatcggctcatactttcaacagtttcgtttatttcgcttgtagcagttgttatggacaagttgccgtacaattgaaccaccaacagatatttcattgacgttccatgcttttgtacaatctatctccttgccgcataacggacaagtccgcttctgcttgttccataaatataagagtgacttacgtcctttgagagattccagcatttgttgctcctttcgctgaaagaaataatcatcgtattccgggtcgaaagggtttgcctcccccttgacttgcttgtacggagtataatgtatatccgacaaccttttaagggtcaggtagttcactttcttgctttttgtttcatatttccatgcaaacgtccatttacgcccccgaatttcatgccaatacttatctgcaacccaagacttgcgtttctttgggtggcgacgtaaagcccatttctttgtgaggttgtaaatgtgattgtcgcaaccgtgaaaagcattggttgatgcaccatatcggtaatagtttccccaacctgttatcacaggattgagcattcgtatcagcgattcctgcttacacattttatgtcctttaacgatgtcactgatttttgccctaaagcgtttctgtgcatctttggacggagatgtgtacagccttttgccgaacttccttacattgaaacctaagaaatcaaatccatcgtatatgttcgtaatggtagttttctcttcggataaggtaagacccctttctttgagaaattctatcaccattggtttgacctcgttttccaataattccttatctcgacccgtgattataaagtcgtccgcatacctgataagattcactttgtagtggaatgtcttatagttgatgaaacgtcttttgaatctttcagccaagagtggttgaagtccgtcaagtgccatatttgcaagtgtcggtgatatgatacctccttgtggtgtaccctcttctgtcgggaacagtttaccattgaatacagctccacatttcagccattttctgagtattgttttatccatagggatattttcaataagccagtcgtgactgatgtggtcgaagcaacccttaatatctccctccaaaatccattcgggggaatgctggcgatttagaaccgtatcaatctgacgaattgcgtccattgtcctgcgcttctttcggaagccgtaagaaaaacggccgcctgtcgtttcggctatcggttccaatgccatgagatataatgcttgcatcgccctgtctttcatggtcggtattcccaacggtcggagtttaccgttctttttcttgatgtgaaccctacggagcggctgtggatggtagccacgacgtctaagttcaccgattgctttgtacttgcgcttgggagagtcccaaagctgtttatctactccagacgtattcttccctttgttggaagtaaccctctttactgccaatgccttggcgtaaaaagagtgagtaagcatccactgcaaggttttcaccttgttatgtctgccttctttctgagcctttacaatacgcgcttgtagctttcggacataggtttcacacttagaccagttcataccgtcccaagtcagattcctgctgtcagcaggcgcacacgatgttttaatctcgttcatttgctttcctccttttgaaagttctaaaagttatcttgtaaagagttaccatatacggaagtctgcccactttcgtgtcggatgatgttaccctcattaactcgtgatgttggttcaatccgtatcctccccattacagggcggcattcgctttcttcgttatctcatacctgcaccccattcggcttgccttgcggttcgcttactcgcattattacgagagagatacaggcttgccctgttccacgcaattgacaaacggatagtttaggttctgccaagtccgccggcagtgctatgtccgtgtaaccccaacatgggcgagggttatccgactgcttaccttttggtgagagctaaagtatcttgcgctccttcaaaccttacgacggctaaagtcagttcacattacgttaaccatgctatccagcctcgccactcgacggtatgatactaaccgcccttgacgttccctcacggttcagtcttgtcctttcggaaagtgtactttgtcctataagcttagcacaacccatcactggagatgcaccttatagtaggctaccgctgacggaacagcgggttaaatcttgtaatatacattgctgtttaacaatcaattacgtgacttttcaggtcacacccatataccattcagattcaaccattccgaacgcaccatctgtggacgcggatattccggtaaaggaatctcagccttcaatgcctcctctgtccatggagtaggcaatgtgaacttctctaggatttgcgcctttacggagaagagatctcccccaaaaagaaaggagcaaagagctaaacaaacaacggtaatctttttcataaaccaactatttaaataattccggataatatttccgaatcaaatcttgatcttctttctccaacttatcgatcaagaccggcttatcttgcgggcggagacctttttggttgattttgttgatcaagctccaatccttagccggttttgtcggggtcggatcggcaggttcatgagccggcaaatcatagcgggtaaagtcgatgacgtaagccggggaatttttcgtatgccaatcacgtaataaggccaagcggaattccttattcataaaccattttatctccaaattattataagagtctcccaaaccagagccacgttctacgaagtgatagttccagtcgtcgttcgatttatattgttttctccaaagttcgccaaattctccgaacgtaacgaaatgagtatccggccagcgttccttggtacccgttacccacatcttcatggcatcacagatgagatccttcccgaactcatgtaccatctgcgcctcccagatattggcgacccagccaaagccattcaactcaagacctttatcaaagtgaatcgcttccgtgtgcatcacctcacgatgccccaagtcaagcccccaacctttgtacgtctcgatcgggccgacacctctacggctgttgtatccatcgataccatgtccggtctgtccgctacggcgggcacagataaagtccatcgtccagccatccagattcacgcaatcgatgaaatcgctttttccctgcgccggcttgcagaagtgttccgtcgagggatagaaaggataagaaggagaaccgtcagcaccaccaccgtctatattatgctggctccagatcacggcgtgcgccacatggatgttctctttctccgccaaatatctcaaattatcggccgataagaaacctcccataattgactgcggacgataaccatttcctaccattttagaaatgatctctatcgcctccgacatctcacggtttacccgctcacggggtagatacatcgcaggaaaataaccggggaaataagtaacctcatccccatatttcttttggcactccactacataatcacggatctcccggtaattcttccgtccgtcctccaaggcattcatcgtgaatccccatgtaagacgaccgttcgggttattcgtggcgaaagcctcccgcaaggcacgtactccctcaagcgtatgccaatccacctcatcgcggggatgtaacttgacatcccgggagacttcccaaggcgtcgtacgtatcatgatacataaggtgacaaaacgatttccttctatcgtcagcggttccgtattcgccgggacgaccacaggatccgccgcccttaattgaaaaccactgagcacagcgaccatccatacgatcacccattttctccaaactgatatattcatattactttctcgcatttgtacaatctattactatttcctgatccgacggaaatatcctaaagacataatccgaaccagattcaggtttccttatatggcctttctcgcaggtgatcacgtagttgaaaccatcgaagctagcgttgactgccttatcctctataacggtgaaaggtagctccttccctgccgcagcctttagctctaaagcccatgagaaatccgcctcctttgacagagcggctacctcgaagcgggtctcatagaaggtgatcttgaaagcatggccttttgagtcttcggcggaaactaccaaggtatccttgcctatctccgtcactaccggatggtccaaggaaagttcctccttatctccatccttgtctaatcggacgatccgaagcccggcacgatcgagtccctcgctccacatgaatccgtccacgaccggcaacgtatagaataggaactggttcccgtctccgggcttttccagataaaccgacttatagctctcgtcgaaaagatggatatccctaaagcggaacgttcccttctcccacaataagttcgcccgataataacggctgttaaaccagaccgtcttattgccttctccacggacatccgtcaacgtagtgacagccgtcgccggcgtaaccttgaagcattccttgaaccacgcaccggattcgcccagcgtctccacccggatcttattttccttcctcaaggagtccaagatagggatctgcatctccagtcccttgctcatattactccacgtgaaagagttctcctgtcccgcttgcgcataattgaaggccagacaaggcttgttcacgatcgattccaagaaataatccacccagcggcgatccatgcccgccttctcatacacgggttccaaggagatcaccccttgacgctcttgtcccagaccatcatcatactgataaataggatcactgcccagcatacggaaaataggaacggggatttgcccctcctcggtctgcgccggcatataagcgtttatccggcttgggtaataggcttggttccagtaaccaccccatagggtataaccatccgtccccacttggtccttgcagttgcacgacgccacgatcttatatttatcgtacatataccccaaggtatgcgcgtcgataaaccaagagccgaccgatttcgggtacgtgccgaatatctccttgaacttcgccatatagacatccaccaatcgctcccgttcttctttcgtatatccggtgctgaaagcgatattcgcgtgcgagacccaagaatgctcgccacgccacttgatcccggcggcctcgatctgcggttgcgtaagttcccaccaagcgccgatctcggaatgatcattgagtttacttttcaacagatcttggtacaatgggttgatcaacgcatcgtactgcaataagaaggttgccggtaaatcatatttattcaccaatttcacttgctcacaaaccgtctcgtacaataaactatcagcgttctccacccggtaatctgtctggcggatgaaattgatgatgttgataatacggggagcagccgcactctcaaccggtttctctcccgcgctacggcatcccgcacagcagaagacgataaagcatacaagacctatcttctttatgaatgacattcgattcaattttaaattcatttactctcataaaatattctagaaatggcatttcaccggtgtaaaatcatttttagagatctaaaaagcatttcgcaagggtgcaaagccatttcttaaacctaaaaatggcatttcacaagcgcaaagtcgtttttagaaatctaaaaggtacttcgcgagggtgaaaagccatttcttagatctaaaaaggcattttacaccagtgcaaggccatttttaccggaatataaggcattaccctaccaccccggattgttcggagccaagttcgggttcagatacaactcatccaacggaagggaataatagtaatgcttcggggtcacaaagttacgattctccgccggttccacaatcaagaaaccattttcgtctgtcaaaccgggatttccctcgttcaagacatccaagttctcgtattccgaacctttcagcttaataccttttatggcacctatcaattccgtctcagccgtcttccaacgtctcaaatcatccctgcggaagccttcgaacgctaactcgatcgtacgttcccgacggatctccgtccgcatatccaacccattacccttcacgaaagcgttggtcagaggaggcatctccacgcctttccgggaacggatcacattgatcgtcttgttcaagatgtcatcgctgatcgccccgtctttctcgtaagtggcctcagccaatatcagcaatacctccggataacggatgatgtgataatcatatacatccttgtcagaaggaacggaagtctccgccatatatttccacaacttataacccgtacgtgtctcgggacgtatggtaaattgcggcgggcaagtcaaggcgccgtcttgcggactgatatagtcggttccgggcatcaagaaggtctgtttcatacgaggatcacgattctcgtattcgctcttgatcgtggcatatccctcaaatccggaattagcgttctcaattggcaatcccgtactcttacacaaatacatatctgccagcttacgggtaggcgtccctcgccatccccaatatacagggcacgcgtcgctatggtggcggatatccgtctcgtaccgactgtcgaagataccttcttttgaattatcgcccgcattgataaacaagtagcggtagctctcctcaccagagccttcatataaagcatactcaccactatcgatcacttttgtagcggcatcgatcgcttgttgcaacaactgctgatagtccgaacggtgctggtgatacttcgcccacgtcccggcaaacaaggcaaccctcgctttcaacgccaaggcagcgccttgggttacacgtcccgcctcatccgagcttaactcactttgcaagggtagtttagcatacacctcgttgagttccgacaagatgaagtcttccacctcctgttgcttattcctagaaccatacaactccggggaatctacggtaagcaccttcgtcaagataggaatatcgttgtatttcgccatcaaccgaaaatgcgagtaagcacggaagaaacgggcctcagccacataccgctcgatctccgagggatcgccctcgtacgtctggctcttctcgataatcatattgctctgacgcaggtctatgaaagtagagtcccatagggcatccgtattcggggcgatcaacgtaccgttactcgtcgtattctcgttcaactcataggcgatatcgctatccgtatccttcgtgccgaacgtctcggtacgtgtgtagagccaattgacctctttctcgaaatcatccggggttttccagaatagctcgtccggcatattatcttttggcaacaggtctatatcttggcaacttgacaagaacaaagcggaaacaataaagcttcccaatattatccgatagtttttcatgacttttcgctttaatttttaaaatacgacatttataccaaatgaataattacgggtaaacggataggaagtaatgctaccgctgttctcctccgggtcccaaccatttggcgtgttatgtacctcaaataaatcctcgccggaaaaatacacccgcaccttctgcaaaccggccttcgaggtcaaagtctgcgggatcgtataaccgaactgcaagtttttcaaacgagcatacgcaacgttaaacttcgtgttcgtagatacataataattgtagtttcgtttatccttcaacgtgatcgccggatactgggcatccgttctttccggggtccaagtttttccataccaatactcggcggattgataccatgcctctggcatcgggcaccggctctccccttccaagaacatcgtcctacggcctactccttgtatgaaagcgctcaaatcgaatcccttccaagccatactcaagttaaagccgaaattataacgcgggttcttgtcacccaagtatttcacgtcaccggagccttctttaccatcacctaatacggatagcttcccgtctccatccaagtccttgtacatagcgtcacctacgctcaagtcacccgggatacccccttccgagaaacgagatttatacgcctccaattcttgctcattctggatgattccatcaaattcatatccgaaataggaattcaacggatatccggtcggagtctcgttattacctaatttgatcaggttacttccaacccgatccacgactttgtttttcgcgtcactgatattaaagcgaaccgagtagctgaaatccttgatctgatccctccagcctagagagatttcccatccatgaatacttaaatgtccgctgttcgtgctcggagcgtccgcacctaacatggaaggatatgtcttcgggataagcatgtttttattctctttccagaagtagtcgaacgatccatataaacggttattgagcgtcgagaaatcaaatcccacattggttgtctggatcgtctcccatgtacgagaggtagaaataatatttccagacgtagccatctgtcctttcatgccagccccgaaaggataataatcgttcgataaagagatcaattgaatataatcatacaatccgataccggactgattacccatctctccgtaagaagcccttaccttcaagtcctcgaaccaacctaaccgtttcatgaagccctcttctccgacacgccaagccgcgtttacacccgggaaccatccccagcggtgatccggatcaaagcgggaactaccatccgcacggatcgttccttcgatgacatatttattggcaaacgtataattcactctggaaaagaaagaattaatcgtccactgatttccctcgctccaagcgttttgatcttgggcgctacccaattgcaaagacatattttcttgttggtcgaagttaatacgcttcgccgtgaaccgatcatagttctcagactcatgggaagtaccgaccatcacgcttaaatcatgccggtcattgaagttctttttataatcggcatagagcgtgaagttcttggataaagttttctggtaacgacgctccgcactattcggcgtacgtttctcccgaacctcgttattatcccaatcgtaattgatgattttcttgttcgtcacgttctcatcctgatcatacttacggatcacggcttgccccaccaattgtaatccgtcgatcactttccagcgtaattggttgttgaccgttatattacctgtagtcttattcaccatacccccgtcttccaatacttgagccggattatcgaaaccctcgaatgtatagaaagttcccgacggattgtacatcggagtccaagagcgagtcttataaatcagttcccatatattttgtccttccgtcaaacccgaggaatagtccctgttgcttgcctcataagctaaattaagatcgtaagtcaagttcttgaagatctcgacgctcgatttagcacgtacgaagtaacgcttgttcacatcctcaccaaatttagggataccttcctcccgctgatggcctaaagacaacatatacgagtatctctctccaccgccggagatattgacattgtaattctgcatattaccattgccaataagcatatcattccagtcttgatccttgaagaattgcggataaccggtccaacgcccccattccgcatcgggcaataccagatcactattctgccggatcaattccaattggtctctcgtgtattccggagtgaatgatccatccgtgatctccaaggccatctccgcatgttgtaatagattcgccggtttccttaacaacgcaggagtcttaatagagtaatatgcatcaaaagcaacagatgtcttctgattgcgcttaccacttttcgttgtcaccagaataacaccatccgaggcacgagcaccgtaaatagcggccgtaccatctttcaatacggaaatattctcgatatcggaaggattgatcatattaatgtttccctccgctccatcaatcaaaacaaggggagtaccaccgttgatagaagagacatcacgaaccttcatggtcatgtccgaacccggagcgcctccggcacgtgtaatcgtcaaaccgggtacctctccctgcaaagcctgagccgcattctgaaccggacgagactcaaacgctttcgcgtcggccgtagatacggcaccacccaagttcgctctttttaccgtaccataaccgacaactacaacctcatccatttgcaaagcatcttcccgtaacttcacgttcaaattcgcttccttgccgggacgcaattccgtcatggcatatccgatgtaagagatttgaaggacaccgttttccgatacctccatcgtaaattttccatcaaggtccgtaaccgttccgttggtagtacctttctcaactacgttcgcgccaataataggttcaccattctcgtcggtcactacaccttgcactaaattcttcttttgcaaaacggcttgtgaggaaggggcggctttctcgttttttgtagagggattaatcaagatgaaattattctccgtaatctcatactttacgccttcccctgcgaaaagacgctttaaaatggtttccaccgtctgctctttcacatgtacagatactttcttattcaggttaaccttctcgctctcgtagataaaacggaagccagactgtttctctatcttgaaaagaacctcctttattgtctggttattaacgtccaaagacaactttgtctcttgcgaatagacagaggccgagatctgaagtgaacatgcgatagagaataatgtcgtcaatctcataatagacaaagtttttttaaggaccggagactcttccggccttgctatattccaaaaattcatatatttgtaattcgattgtttgttaacactagtgttacgagcactaattttaatgatcaaaaagatgacggggaatgttccagcatttcccgtttttcatgtgtattcatgcgattcctgttctttacttcataggcagactttatttagaggttatacttatattttttcctttcacgttataacttatatcactcaatcgggatagtacgcccaatatatccgttatggtttcctcctgtatgactccatcgtaatgtatactattctccaaatccttttgaagatggatggttacatcgtacctcctctccagatatttgcagacggaagccaacgacatatgatccatatagagtttatcctccagccagctgtacgaatgagataacacacccgatatcggtctcatcttgttggtttgcttatcgaaaatcgccatgtcaccggcgttcattaacaacttatcattcccatgatccaactcgatacagccttccaccaacgaggcttcaactgttttttcatccgtatacgcttgcaaattaaaagaagttccatgtacctttaagcgtaatccattgctcatcttgatcacgaacggtatcttgttcttcgagacatcgaagaagccctctccttggaaattcacttcccggatcttctccttcgcgttataggaatacgtaatatcagatccagaattcagcttaacaacggaaccatccggcaagaccacctccgatcggcttccgtaatcagcggtcattcgaaccagcatttccggctgtttatcaaatactcccattttcgaaaacccgaggacaagcaataaagtagccgccactcctgaaatgatatatccgatattcaccaagcgtttccgcttattatctctctccttattgatacgatcgatcttatcccatgcgtattgagcattaaaagtttcttgctccagataagagcctgtttctttccagatctctttataccgtttaaaatcctcttgattagactcatcctcagccaaccattcatccagaaccggatccacgatctcttcattcatcctctccgataaatggtcaacgatgtgttctcctatttgctttttcttctccatgagtctagtctttatttaaatgacaccacaaataaaaaaaggtcctatacgaaccttgaaaattttctcattattttatacctccttcatctccagacattccttcaacttctgtaaagacatccatatttgatttttaattgttttcacggatatagatagtttctccgatatttctttctgcttcaatccttttaccctgtgaagaagtaacacttctctactccgatccggcaaatggtctatacaatcataaagagcgatcctaaactcttctgtttccagttgattatcctcataggatagaagtaataagtcttgattctctgataaacttcccgtctgcacctttgatcggataaagttcaaggccagatgtttagccatccgatataaatatcctgatacattttcctttatctctattctccccctatttttccataaattcaagaaaagctcttgaacaacatcctccgcatcatttctatccatcaatagactatacacatactgacaaagacgcccgtaataacgatcaaacagtttattataactgatataatcattatttccgatcgctagcattaagaccttatcggcatgaacttcctgcatataatcttcatttatcatgaatattcacaatcgtctttacaggtaaaagagtttcggcaagactatggctaacaaaaagaagaacgaagatataaagcgaacaaattcagtttgtaaccgaagtttaaaaagatgcttagtaaagagatctgagatttcaggaaaaggagaactggattataaatatatgtggtagaataatttacagtttatcaacaaaaccatagtcttgccgagactcagttgaaatagatctcagaaggatattttacaagaaattaatcctgcctttccacaaatctcctgtgacgcaaaagtaggaaaattattatttgattgattattttatcattcttttcatataagatcatcttcccttttactccccagcaaataaaaagggaaatatctcacgacacttcccttttaccatgaatcttatgtttgaattattttacttctactacaatcatcacagggaaatgatcagatggaacacgagctacatgtttttgcatggagacctccttcggaaaattcgcattttgctcattcttcgcatctttcgcttccgaacgatatgtatccgtcaagacaccatattttttcacatcaaactctttcgtaaggaataaatgatcgatacgactgtctgttttgcgatccgcatggaaggcattaaacgtgccgttgggtacataccggaaatccgctatctgataagaatcccgcataataccggaattgtccagtaataagtaggattcattatgttgatccacattaaaatcacctgttagaatcgccggtagcttctccggaaattctttcaacttcttaaggataagttttgcgctttccgcacgggcctgtacaccaatatgatccatatgtaagttaaagaacaagaaagtaaagccggtttgtttatcccgaaatttaccccatgtgcaaatacggggaagaacggcatcccatcccttattagggcgatcggttatcgtagacaaccaaaagtccccatgatcgagcacctcgaactttcccgtacgataaaatatggcagaatattcaccagcttgcttaccatcatcacgtcctaccccgatataatcataaccgggcatcgcattctttagatcttgcaactgatgatatttaccttcttgagtcccaaagatatcaaaaccatggaactgcaccaattgggcaatgtagggataacgttgtccccagccattcccattcgtcgagtctcccgcattcgcattacgcaaattataggtggctactaccattgactccgcttgtaacgcaaatacggaacaaaggacaaataaaaaagaataaattagcttcttcataccttttatcataaaattaaatccacatcaataaattagaactctgcctctatcattatcgggaaatgatccgaagagaaatgcccatactggcactcgttcaaagtcccatatttatttacctgaatacctttagtgacgaaaatatagtcaatccggtttttcatcggggcattcaaattgaattggtttgtcgttcctaccgtcccatagggtggtgtttttgagatttcccgtgagtccaacagtaaaccatcggatttcagtatttgtataggctcagaatccggcgtaccattgaaatcacctacacagatagcaggggaatcccccgctatctttttaatattagccaacattatcaaagcagactcatgacgtgccaccttaccgatatggtcaaaatgaacgctgaagaaataaaattcctttcccgaaaccttatccttcaacttcgcccaagaacaaaccctccggcattgcgcatcccagccaaaagaaggcttatcctgtgtctccgacagccagtaatttcccgagtccaataatttaaaccgatctttcttaaataaaaccgcggcatgttccccagcctcttttccgtcatcccggcctacgccgacatacgtgtacgtatcatctttcactaattccttcacttggtgaatcaacccttcttgaatcccaaagacatcaaaatcatggaaatgaaccaaagataccgccatgtctttgcggtgtacccatgaatcatccttatccccctcattatcataccgcaggttaaaactacccacgttcagtttacacttctgttgtccggatatccctatgcagaaagtaaataaagagataaacactataattaagtttctcatgatacccccttgattaccagcccggattctggcttagattcgtattgaactgaattactacctccggtatcggatataagtactgacgagccggccagctacgtccggcgtaattatactccatcaaataacctccttgaaccggcttcacgttaagcacattactcttatttgtacccacatagacaccaatcgcagcatacttctcatcagcgatcttatccgtatcatagaaataggcatcataattaccatcgccattcacatccaacggttggttaagtgatgggataaagataccttcccaaggatcgttcacccaaagatcgcaacaattccaacgtttcaaatcatttaggcgcaaaccttccagacaaagttcaataccacgttcgcgacggatctccaacaaggaaggatcagagatcgtcgggtaataagaagcgatataaggctctgcggatgacggacgggttgtcaatgtacctgtctgtggtgtgcctcccgtaattcccgcacgagaacgaagcgcacctatcgtagccgcccaatccgcatcagtcagttcgcctaattcagccttagcctcagcatagttcaacaaaacctcagcatagcgcatgataggaatgtcattatcattcgtagccgcatcatcgtaagccacgtcatccatggcaaacttcgtaaactgatatcccgtcaatgtatgtcccgtaaaattagccgcggtcggctcataaacaccagaagcattcttacgggtataatccgctccccggatcgtctggttcaagcgggtatcacgtcctgttgtctcctccacgaaattcttatagcttccatccgcttttttctcgacataaggcgtaccatccgcattcaagtatgacagcataaatttacggctcatgcataagtgtggtccgtaagtagaggaattataccaccaattctgctcacccagtcctaacaccttgtcagtctcgatagccatcattacctccgtggtaacggccttatcggcaatgaaaagttcgcgatacgctccacggccatcgctataagcacccgaagtataaagtttgtacggtccgttatccataacttccttagccgcctcagccgctagtttatataaatctttggccgaatattccgtacatcccgtacgagcgatatccaattggtcagcggcatggtatttacgccaagcagcctcaaacaagcaaacacgagatttgaaagcggcagctgtccatttatttacgatcgttgaattatgcgtgacatcctcttccaatatattcgtatacgcataatccaaatcctccaagatatgcccgataatcacatcacgtgtatcacgcaggttataaagatccgggtcttcagcctcgttaaataccttatcaatccaaggtacctcgccatattgtaccaatttatcaaaatagaagcgagcacggaacaagcgtgcgataccattataattgtcacggatagtcgtgcttagtgactcattcacgttattctccaaaaagaaatttatattacgaagagcggaccatgaccaactcgtcgcgctattcgtagtataagcgccaacctccataccacccaaggaatttttcaccccataatctgccgtagcatcacgccggaaagcgcttcctcgggaaggcaagacattgtaaaatgagtacgtatacgtcttcaaaccattctcggagctaaacaccatatccacagaagcctccgactttggttcctcattcatctcgcaccccgaaaatacagccaaaagtgccaccagaccgcttaatagtatattctttttcatttcgtataatctcctattctttaaaatgtaacattcaggccgatgctgaacgacttcatcatcgggtaattatatccatcaccactattgctggaggtcaagtccttatccgattcaccgatattcgatacattgacatccttggaatacttgtaaagcggagaccatgtaaagagattttccccggaaaggtaaattcccacatttgtcaaatgcaattttttaatccattccgacggtaaattatagccaacctgtatgttcttcaagcgtagataggccgcattcatcaaatagcgcgtgttagcgttcttatgacctccatagaaaggcgcatagtaaccagcgtaacgaggcaagaatgcatccgggttctcaggagtccaatagtttcccacatgccaagaaggcatctggttatacgggcgattgtattgcccccagaacgtagaggcttcattagacggataccaatcctgcttacccactccttggaagaaagcactcacccagatattgttccaatcggcagaaagcgtaaagctataaatataacgaggctcctcgttaccgatgatcttacggtcgcccggatcatctaccgtattctgtccacgatcaatataaccgttgccatttaagtcttcaaacttaatatcacccggatacaacttataggttttcgatgtttgcatgagcggattataataggattgtcccgcagctttcgcggcagcctcagccgcatcgatactggcttggtcctgccacaaaccattggatacaaatccccaaatctcaccgatacgcatcccctcataataattcttgtcgagtgattgattcgcatactcgctcaatgacttattcgcattattaaacctatcgatcactgaatagtaatctgccaatgtacccttgatgctataattaaatcgcttaccagctaaatcaaatccatctctccattccaaagacaactcatagccataagtagacatatccgcataattacctttcggagaagaagcaccgaacacatccggcacggtcggaccattcacgatcatatctgttgttttacggatataataatctccacttacggtcaaacgattatcaaagaatcctaaatccgctcctatatcatacgtcgtagcggtttcccacgtcaagttgccgggaagagccgccggagatgacatataattctgccgcaaaccgtcaagaatataatcagacttgctgatacccaatgtctggatatactgataattactcaatccggccgcattgcccaaagagccccaagaaaaccggaccttagcgttagagatatgttcggacttaacattccaccaaggttcttgcgagattcgccaacccacggaagccgaggggaagaaagcccaacgctcatcactcgggaagcgggaggaaccatcgtaacgtccgtttacctccaacagataacgatcatcaaaggcataattcaaacggaagaaagcgccgccaaactgataagccttccattgtgaggtaatactccggttatcagtacccatcaccaaattcatgttgtccacgtcgtccgtcaacaagtcatcattataagcatagatgcgtttgaaagtagatttttcgtaattccatccagccatggccttgaaataatgtttctcggcaaaagtttcctcaaactctgcgaaaaggttcgttgctagatagttcgtatgatcagttgtctctgccaaattggaataggtacccgtaatatgttcgatctggctttccccatctgcatcaaccgaccgtgcatacggtgaacgtacttgtttcttggtcttctcttgcgtcttctgttgatacgtgaaatcaccattcacacgcaaacggtcacccaagaacttagcattgaatgtcgtagtattctttaagttggagttctttgtcgtaataccgctacgtccataaagcaaatcgcctacggtatagacggcagaataagtcatcgtaccatcagggttgaacagtggcgatgacgggtgtccctcgtctgcgatatttctccataccacaccagaaccttccgaataggtaatcggattgtagtatttattatgggaaaactcaaagttattgttgatcttcaaccaaggagttaactgataacctcccttgaaacgcatgttataggtcttgaacttatccgtttgctcatcgctatcgaaaagtccatcgtaactatagaaacgtcctgacaaataataatcaaacttcccgtcggaacccgagatggaaagattttgattctgcgcgaagacactcttcttatacatcagatcataatagtcggttccttccggataatacacataacggccttttgtaccgatagagccatcagagatcaccgtcccgaaatcgcccgtctcatgacggcgcttatactcatccagccaagccacggaaaattgctgtgtcttgttgataccggaaggattcgcttgattgtaattaaaataagcgtcataaaaatgctttgcccaaatataaccatcggaaactacatccggcacattctgtggtgattgtaatgaatagctagaagaccatgtcaccttcggcttaccttccgtagcgttcttcgtcgtgatcaaaaccacgccaaatggagcacgtgcgccataaatagcggaagcggcagcatccttcaatacggaaatactctcaatatcattcggatttaacatagaagggtctccttccacaccatcaatcaacaccaaagcactacccccattgatagaaccggcgccacgtacgttaaaatccgccgtacgccccggtttaccatcagacaaggaaatattcaagttcgggacaaccccttctagcatctgagtagcgttagccgtaggacacccctcgaatacatcactagtcacttgctctaccgcaccggtcaaattcacttttttctgggaaccataacccaccacgactacctcatccagcttctgcgtgtcctcatgaatagatataaccaaattatctttattgcctaccggaacatcttgagccacataaccaatataagaaacctgaagtatcgcattcggagttacctcaatagagaaatgaccatctatatccgtgatggtaccattggtagatcctttcacgaccacattcgccccgatgattggctcccctttcgggtctgtaatcgtaccggtaactttcttattaccttgttgctgaacagtttttaccgatgataaaacgatctgatgacccgatttcaatacataagccacattcgcttgctttgctatcgcatccattacagcattaatatccgcatcttccacgtcaacagagatcggagaattcagacctttgatcccatcattatagaaaaaacgatattcagtcgtttcctccaattctttaataacctcccgcatcggtctatcctttaccgacaacgatatctgggcggcaatcgcaactccggaaaagcccgacaataattgggcatacaaaagtgtccggaaaaaagagtgcttgaaattactcatttttaaaagttttttaataatacatagattttaaacaggtaactttacaagcaaatcatttacatattctatcttatttataaccggctagttatttcctttaagatattatatacaagtgattttgcttaagaggaagaagggccttgcctttcttcttttttactacaatcatctagctcatctcataggcttcttctttattaggttaacactcaacttcctatttctcatttaaataaatagtatcacctaccgacacatacgtaatcggagccgtaaggcttattatttcaaatacattatccagactattattccggatcacccccgagaaactgtagcctttaatcttattggacaaaaaacgaacttcaacattatacattcgattcaacaatactgcgatctcctccaacgactcgccagagaaggccagttcattcgtacgccaaagacgggcataagaagcatttgtcgggtgattaacagataatatatgactagacttattaaaaaccgcactctcatccggagacagaatcacaaactcttttccaaccgctgttcgtacactgccttcaaacaaggtcgtaaccacctcgtcatcttcctcatacgccttcacattaaaagctgtgcctagcgcctcgacttccatatcccccacatttaccaagaaacgacgcaatgtatctttcgaaacttcaaaataagcctcaccagataaagaaactgatctttctttcacgccataatcactcttataattaagtttagtatgcgaatttaaccatactttcgtcccatcaggaagaaccacgctagcacgttgcccattatctgccaacaccacataatccaatggatcaggtggtggaacctgtctcatattataccaatgggagccaattccaaggcctatacatattaaagccaccgccgcataagaaagccacttccataaggtatgcggtttcttctttatctccaaagttttcttctcttgtcttatccgctttttaatctcacaaaacatctgtccttgtagcttaggaggaagctttttcccggaagattcttcccatctagacttataaaaagccatgatctcttccttatgatcgggatctctaaaccacgccaaaagagttcgctcttcttccggtgaagtcttaccactcatgaagcgatccaataattcgatatgtgtatgcatttttctcatcgtgtaataagtatatcccgaaaaagaactttacccttacacggaaaaatcgagagatccgtgatttaacacaaattaatatcatacttattttccgccttcataagtaaacggtcgatgttccttttcgcatgtacggttacgaaaaggattttcaatagagtaaatgtttttcactaccaaaccgacataacctttgactgatcaaaacaatacagatgataatcatcatcccagcccaaggctattagttctttatcatcgtttgtcacgcaaatattgaatagtcttatatccgtaatcaatcgacaaatacattttccactccaatcatatacatacgtatatccgataaaactatctacccctacaaaccacaagatatttaatgcttattaactataaaaagagtgttataaggcaaagaaagccatcagaagaaagtcgatctcgcaaaaaacgcaaagccctactcaactgtgtctccacagtcttttcagagatagagaggcgttccgctatttctttataggataaatgctcatgacggctcaaacgaaatatctcccgacgggacaacggcaattcttctatcaagctattaatatattcccgtaaagactccgcatcaattcgctcttccataagcgaatcaacatctgatagctgtcgttgtaggctttccgtcagtttctcggagagtagccgattctctgtctctttataaactaagttacgggcgatggtgaatagataggcgtcaaagttttgctccacatctatcgtctcatgcttctcccaaatcttaagaaaaacgttttgggtcaagtcctctgccatagatttttcatatagtaatgagtaaataaaatgatatacatgctcattatatttccagaatagagtctcaaaagccttttcatctccattcttcagatctataagcaaatgtccatccactttcatattacatatatattacatatccacgccatacaaatcttatctcctttctgcatatttgcagttttcatatacatgagttctgatgaaactatgtcggttagtgtagatgatatgaatgataagataaagataatcagcggataactaaatagtaaaattaccgatggtagtggagaactaaagaaaaaacgaactagatggttgttatttagatatttatattataaacaagacatggtctcatcagaaccaagtacaaggttactaataaatatccaaatataaacaagcatcattacatatcgcaaatatacaaagaactcgcaaaaaaacggcaaaatttggataaataaagtaagtgtttggtattgaggagagttaagccaaattcttctatacctttccaaatcgctaaaatgcaggataatgaaaggttaagagaaagatttgctacttatccgttaccttttttagccccggataatccggcaaaataacgcttgaccacctgcggttttaccgttcaccatgcaaagaaccctatattttgcccgtaaagataaccgtttttttccgtttttcatggaaatacaggttatgttaccggcatccggggttttattctttgttccgctataattttcataactgtaaatagctatatatcaagtaattttgcaacataaaaaaaaatagagttatgaaacagacggatgtaacggttacgttctacctcaaaaagagcgaaatgaatgacgagggacattgcccggtcatggcgaaacttgttgtcggcaaattttcagaagcggcttttagtgcgaaaatgtccgtacccgctgcactgtgggcatccggacgtgccacgggtaaaagtaacgccgcgcgggaaatcaaccggcaactggacgatttgcgagcttcagccatttccatttatgccgaactgtcagccacccgtgagaatgtaacggctgaagaaataaggaatctgttgttggggacagctttcgggcaggaaaccctgttgggttatttccggacgttcatcgaacatttcgaaaaacgtgtcggcgtgaaccgggaaaagggaacagcgcaatcttaccgctatgcttgtaactgtgtggccgctttcatccaggagaaatacaagttgtcggatgttcctttcacggccctgaaccgttcattcatcgacaactatgacctctacctacgcacggagcgccgctttgccctgggaactatcgtgttgcttgtcacacggttgaacacgattgtcggggaagccatcgcggaagggattatcactgccgacccgttcgcgggttatgaagccgaacatcccgagcgggaacagaaataccttaccgccgtggagttacaacggctgatgaccacacccctgcacgacccgaaactctaccatatccgcgacctgttcctcttctcctgctacacgggtatcccttacggggacatgtgccgcctgacgacggaggatctggaagtggccgaggacggtgaggtatggatcaagaccgcccgcaagaagacgaaaatcgactatgaagtgccgttgctcgacataccgttgctcatcctcgacaagtaccgggatatggccccggaaggaaaactgctgccgatgtacagcaacaacgaactcaaccggacactgaaacgtattgccgccatttgcggaattgaacggaagctcgtctttcactgcggacgccatacctacgccaccgagatcacgctttcgcatggtgtcccgcttgaaaccgtcagtaaaatgctggggcatagccgcatttccacgacgcagatttacgccaaagtgaccgatgacaagatcgacatggatacccggtctttagaggaaaagattgccggccgcttctccgtagctatttaatctatcattgacaatcaaattcacaacgattatggaaacgaataataaagagataaaacgccgcagcacgttctccctgctgttctacatcaaccgcacgaaagtccgcaaggacggaacatgtaaattgttatgcaaggtaagcatcgacgccaagtcggccccgatcaatatcaacgcgtttgtcgatccatcgctttggaatccggaaaccaaaagggcgaacggacgaagcgagaacgcccgaacggtaaaccaggcaatagagaaactgaccgaaaaaatcaccggacattaccgtcatattcgtaaaagcctcggtttcgtgacggccgagctggtcaaaaacgccgtggaaggaatcgggcagaaaccgttcaccctccttgccttgttccgcgagcataacgaggagttccgcaagcgtatcggcgtggatcgcaaggaagaaacttatgaaagttacgagaactcctataatattttagcctccttcgtgaaaaaaaggaaggaaaaggaggatgtagcgttgcggagccttgaccgggagttctacgatgattttgaaatattcctgcgtacagatcgtgaaatgaaacccaagacagtacacgagcatctttaccggttgaaaaaaatgaccaagcgggctgtcagtcagggtacactccggcgcgacccttacgggaagctgcacccggaactgccccggcgcaagagccgccatttgaaactcgaagacctcaaaaaactgatggaaactcccgtcggtaaacccaacctccagcgggtgcgggactggtttctcttcgctaccttcacggggttgtcctacgccgacctgaaacgcttgtccgaaaaagacatcacgcagtcggacgacggaacgtactggatacacatccggcgccagaagaccgaaacgccctcggccatccgcctgctgaacgtgccgttgcagatcatcgagaaataccgccacgagcgtaaaagcgacaggattttcaacctctattgccgggggtatctcatcaagctcaccagagaactgggacggacatacggcttcgacatgacctttcacaaggcgaggcacaatttcgggacacatatcacgctctcgctgggtgtgcctatcgaaactgtcagccgcatgatgggacacaagagcatttccaccacgcagatttacgccaaagtgaccgaccgcaaggtggacgaggacatgaaacgtctgaaagaacagaccaaaggccggaaaataaatctctacgaggaggacgaaccggaaacggcagatattataacggtaaacggttgaacagtataacaaaaattgataaatttgtatgactatgacgacaagagaacctatcagcattgaaaacgggcgggtggaaatccacacgccggagaaccgtgtatggctcacgcgccaccagattgccgacctgttcggagtcttcgttcctgccgtggggagcaacatccgctccatactcaaaagcggcatactccgtgaggagcgggtttaccgccgggagcgcaaccgtgacggcggtattgtcgagctgtattcgctcgaaatgatcgccgcgctggctttccgcttaaaatccgggaatgcagaagccttccgacggtggcttgtccgaagggccacgacgaccgctgtcgtctggcagctccccggcatgaacacgatattgaactgaaaaagaagaacggccaacgttttggccgttcttcttttatatccattcctgtcccccgatacatttcttccgggaatcttccaggaatttctgtatctcggattccatgtatagtaccttgccctgaatcaaataatagggaatgatccgcgccgtacggtattcctgcaatgtacgcctgctgattttcagcagccgggacaattcctcgtcggtgacgaaccgctctcccttgagtgtccggcctccggaggattccagtttatccagtgccttgccggccttttccaaacgccggaagagatccgccacacgcggatcgtgcttgtcgatgaaataatggctcataacgcggcggtattaggatagtgcgacgattgcagcagtttcccgacatcttccggtttgtagaagattttgtgacggatgcggctgaaaggcagcaaccctttctcccggtaggtttgcagggtacgtttcgatatacccagcacgtcacagacatcctggttgtccagccattttttcaaactcacgtcctcctgcctgcggcataacgcctcggcttttctttcaatggcttccacgtgccctgccagcgcgtcgaaagccttcacgtccatacttattatttccatgttctgtttcattttttgtttcccggatgcccaaaagtacacaaatggacagtatcttgttatcagccagtggcatatggacgtatccgtcttaaaagtggcagcgagtggcgccacgtccggcggaaacgatcctccgccgatacgggatcggcacgctccgatacgccaatcgcccgtgaaaggaaatgttcgcgggcgatttatcattccatgcagggtgagccgtgaaccgactttcgcgagcgttcacggcatatcgttttctccccgtttctctcccataaccttttcctctctttttttcatgccgcggagcgcggtatggaaatctgttgtcagtagcaaaggtagttacggggctcacgctgctgcaagatcgggccgcggggcggtttgccgcaaaatcttcctctttccctgcgggcgagcgtattttccgacaaaatcttgcagcagctatcccctacaccttttgatgctaccgaaacagattccatccataccggctccgctacggcataaaaaaaaagtcaaaggttatgagaaacgaagagaaaaataaatggaaacagaaatcctccaaccttccacttggcataaaggcaaaggtcgggttggcggtaaaggtcggggcggtggctttgggcttccacgtgtggggtatcgactttatttgggtcgttttgggcttcacgttctgttatgacatcctgcggggcattttctcctgccttgtttctctcgtggctctaaccggctttttctatttcctattcactcacatcttctaaattattacaggtatgacaaagtacatttcattattcggagcgactaccacggacacgcaggtgcaggtagtcaagaaaaaccaggtaatcatcggtatcggtgcgggtgcgagcagaaagcgttacgtcgtttacaaggtggaacacaccgcccgtggctacgtgtaccacatggtcaataccgaaacaaaggaaatcagccaaacggacattctgcgacccctctcgcaaacattcggtatcggcaggtactacgacgacgtgaaccccgagttcatggacgctttcgaggtggctttgctcgtggggcaggcggaagagcaagccacggcgcaggccatcgccgccgccaaagagaaagccgagcatgaccgcatagcggaaataggggcgcagaggttacgccgcatcatgcccgaaggggtgcagggcgtaatcatcgccgaactcaacgaaacggaatacactgacccctcttacgagtgttcgaccacccgaagcgtgcgtaccgtcattctcggcttttcggccacctcccgcaacgacttcggggagttgagaaaggcggcggccaatttcccgcaaacggcgcacctctccgaatacgaccccaagaacgaacaccgctatcccgttttcacgctcggcaaaagtccgaaatacgggtggagtgtctgcaaactgacccactacacccgtgaagggtacatcgacaggctggcatatatcgcaggaaacgaggagaatatatgtctgcccgagccgaaagacgaaaaacgggcggaacgcactgaaacgagcgtgcaaggcgggtttatcatcgtggactattccgagaaggcgatagccgtattcggggacaccaagcccgtcaaggacgcccttcacgcactcgggggacgcttcaacgcacggctgacgcatgacgggcagaagagagcgggatggattttccaaaagaccaaagaggacgaggtgcggcggcttctcggaaaggacgaataaatgttgaacacggggcggctcgccgccccacaataccaaaaaatcatggcacaaggaacagattatttcaaactgacgatacagaactatctcgacgcacgggcacgggaggacgaacttttcgcaccccgatacgccaacccgaaaaagaacattgacgattgctgcactttcatcatcaaccaagtacggcagagcggttgcaacgggtttgccgacgaggaaatatactctatggcactccactattacgacgaggaggacatcgacatcggcaaacccgtcagttgcaaggtagtggtcaatcacaccgttgaactgaccgaggaggaaaaagccgaggcacggcggaacgccatacggaaggccgagagcgaagcctacgccaagttggcgaaagccaagtccaaacccaagaaaatcgaagataacaaactaatgcccagtctattttagttatgaaaccgagaacaaaattccaacagagcgttgtggcggcaagcaaacacctgccgccgcttacccccgcacaaatcgaatgggggtacaagaactgcatcgagcatatcggacgccgcacgccgaaaggacttatcacctgcaccgagtgcggccacacgtggcagagcgaaaacggagaactcacggacaatctgttagggtgcgagtgtccgcactgccacaccacgctgaaagtggaaaccaccctgcgccgcaagttcaacgattacgagtatttgtgcatcgtaacccgctgcaagggttttcaagtcctgcgcttcgtctatatcgagtgttgggcgaaagtgggacagacacccgtttacacccatatcgaagccgtacagcggtggattgcccccgacggacgctccgcaaccttcgcacggctgcgcccgatgggcttcttcgttcacgggtggagttggtcgagcgcattggaactgcgggcggagaacgacgggaaatacaacatcacgcccacacgcatctatccccggcaacggcttatccccgaactgcgccgaagcggttacggcaaacaactccccgatgtaacccctttcgaccttatccacctgctgctctcggagaacaaggccgaaacgctgcttaaagcgggacaaacggcactcgtgcgatttttcgcccgttcctcccgcaatatcgccgactattggccggccatccgtatcgccatccgtaacgggtacgctatcgggaaaccgacggaatggtgcgactacatcgacctgctgcgatttttcgggaaagacctgcataacgcccatttcgtgtgtcccgcagacctgcccgcagcgcatgacctctacatggctaaaaaacggcggcacatgcaaatggaacggcggcaggaggaacggcgcaaggcgttggaacaggaagcctcgtttgtcaaagccaaaggacggtttttcggagtggagttttccgacggggaaatctgcatcaaggtattggacagcgttgaagccatacggcaggagggcgaggccatgcaccattgcgtgtttaccaacgaatactatctgaaagccgactcgctcatactctcggccacaatcgacggcaaacgtatcgaaacgatagaggtgtccctaaaacgcatggaggtcgtgcagagccgtggcgtgtgtaacaagaataccccataccacgggcaaatactgaaactgatgaaggggaacatgtcccttatacggaaacgaatgacagcataaaaatcggggcggcgaaagccgcccgcaaaaacaaaatagaatgaaccaaatagcatataaattcgtgtcgtgggacgttcccgcactcgaaagccttgcaggctcaaaagcgtacatattacgcaaacggctcaatgatgggggaacgctcacccgtgaggagaaagactggattacccgtgaggtaaaccataacacctatttcaaggactccattctgcttttagggtatcgtttcaactttgtcgatgtactgaaaacattcgtggtaaagcagtacgggcattacacggaatataagggcgtggacaagacgagcatacgctccatgttgtacggcagagtggaaaggattgtcgaattataaaatcggggcggcgaaagccgccctacaaaaaaacataacaatgaaaatcatctataaaagctacatggcacgcccgctcaaacccttcggggagtgggattgggaagttcgggaagcagtcaagacggcccttgcactcgtcgaggggaaaaacgggttcaaaacccattccgagatatggagaaggtgcaacctcgtcattaccgtgggacacaacatctacaccacgagtatcgagatacgaccacccgagcaggacgtgatacgccgcaggagcaactggcataacggctacgcctactactgcaacggcgtgttctgggcgaacatgagcagggttaaagtggaacttgtctgattaaaaaatttcggggcggcaaaagccgcccgtaaaaagcgagaatatgaaaacgaatgaagtaaacaaggaaatctcctatgaaacgctgctcgtaaccttcggcgagggtatcgggcggctcgacaccatgttcgacgacccgcaggtgtggggcgttgccacgctgaagcagtggatcgacgggtatgaaactacgcgcttcaccgaaatcgacgaccgaacggcggttatcacatccgaatacaacatggacagcataaaggaatggctgcaaaagaacacaccgattatcaacctggaaaaacgataaaatcatgcgcaagtacaaattattcatcggctaccggctgctgggagagttttccggtatatgggaagccaaaaatttcgccgctgaaagcggcatgagcggaattttctcgctcgtgggagaaaattaccgggacagttggtacgaacccaaaaaacaagaaaagaatggaaacaaagattaaagacatcacgggagcggaaataaccgttaccgacttaaaagaggcggtacgccaatgccgggagtgcctcgcaagtccctacctgatgccctcggggcataccgtgggggaaaaccatgcctacatgttgcggcaactgctcgccctgcaaaggcggaaacgggaacacggcaggcaacggccgtgaaaatacgacgcgaaaaaaatcggacgacaaccgtccgatttttttgtttcccgtcaatcgaccgccgtatggtcgcccagcttcccgtgcagttcacgcccgatatgtccggcaatgccacggggagaaatttcagagattgaaccccacccgccatgcgtgtatatgcacgtcttgagcggttcggtacgggaaaggtagaacagatagccgttgcggagcaggatgcccacgaacaccgagccgacctcgatgtcggcgatctcgtcaaaacgtatcttcccgtcattgtataatactgccgtgccatccgcatcgggaatgacgaacagatcgtcttccatgacaatcccgtgcaactcgattagcgaccccaggcattcactcgccgatacccggtcgtaatcaccctttacctcatttgtcgatttcgtttccatatcgcttttctttaggttcagacaaataccatacgaaaaaggcgtgagaatacgttaaataccggcattgaggtacagccaagcacccatccactcgatagataatttctccccacgccgctatcgcatacgcttgacgcatatagacacgacgatgaagaagagaactacccattattttgcgagcggattaaaatttggctgttttcaatgccccaccataatgtgttccttccgtatgtaaatcgcccggcggcacgccgccggaggattcgattgcaaatataacgatttcattcgggtatcggcgacaacacgtgcgatttttaacaaccttcctgccaaagaactacccgccgtcctacaatttcggcccccgggcgggtttgcggggcgcgaccttcggctgcgccttcttctccctgggcggttcgacgatccgcagtttgagtttctccgtcttacggtcgtaacgcacctcgcagcagtcaatctcacccgcaaccgacgtccacacgttgttcacacgcaccgcgccgcccgagtagagggtcttgtattgttcgtattcgagcggctgccgcaatttcgcgtccacctgacggtggaacgagtagatattacgtccctttgctatttcgtcgggaacgtaaacccgcaactcgggatgggcggcctcggcatagaggcacagatccgccgtgcgaagctccctcggaacccactggatcatcctcgggtcgccccgcacggccgtatcggccacgagcggcgtgatggccctctggggaatgtcgtacagcacccccgcatccttgcgaacggcctccaacgccacctcctccgttacaagccggcggttcaggtgcaggacactcatcaaccggtgtatctgctgcgggtcgtcctgctcgcggaacacctgcaagaccagggcggggtcgctcaacgcgctgataaccgagaaatcggttttgtccttcccgtaggtacgctcgaaagcctcccggctcatctccggcgtccgggcttcgcgggggacgcctttcaggttttgcgggttctcccgcaccaggctcatgtatagatccgggcttttcatgctctcgggcaggtgggcgatggcatagggactgcgccgtatggcctccatgcacaactccggcgttttccacttctcggggacatattgcaggtagctcccgtcgtgccagacggcccggcggcacatctcctcgttcttggcgtggtcgggaaggttgtagaacagctccggctccagggcgaaaatttcccgggccaccctcggcgtgaggaaccaggggttcatgttctccaaaaaatcgaaggtcttatcgtaattcgtgcaatagaaccccaacactttcaggtgtatctcctcgaaggggatatagcggaggacacgcaggtcgtcggtacgggccaacgcccggttgcagacctccggcgtgagctgttcggggttgaaaaagcggatggccaggggatcgcgctccagcgccatcccgcacagacggtcggttttcagatgtttcggaacgtactccagtgccaggtagttcgaggacacggcggcctcgcagacccgttccgtgcgtaattcctccggcacttcatggagcaggatgccgtccccgctgacggcacgcaggcagactgcctccgtgcgcagttccaccggcacgagcgaaaggcaggacgcgtccatccccacgccgtgaagggccagttccccggtcatgacctccggggcaatggaggcgaaaatctcgaacttgtccacgaacgacatcccgaattttttcagcccttccaggcatatatcgggatacggaatgtaagggagtatcttgtaatcggcactgtccaccgctttcaacgccgcacggcatatttgcggcgtcctcaattccccggggacggcctccagcaccagaccgttgcgcttcacggccgtcatgcacagttcgggggtcttcaacccctccggaacgtaatacagcgcgtagctgttgctatcgacggcggcacggcacattttcggtgtcttcagacggtcagggacgaatttcagtgtttcgccccggtggccggccgcggcaagacaaagttccggcgttttcatcgcttcgggaacgaactcgatgttgaaagccgatttcttgatggcgaaacggcagacttccgccgttttccgatcctcgggcagcgtctcgaaaaggttctcgcgccacgggttctcgtacacccccgtatcgagataggctatatctattctctcttgctctgtcatggttttcagtatttatggaaagcgcccgggtgacgggcgcttctcttggttagacatattacgttatcgttccgtttcctccgtcccgttctcgctctggaacgtgaaggaggtcttcacgacctgacccgtgttgtcctcgacatagacgtcgatggtctgctggtcatcgctgcgcgatgtgtaatagaggcggaacacctcacggtcgagcggatagcggtcgttgggcaggaacaccgtaccgtcgtccatcctcaactcaccgcgcccgtcgggctggaaatagcggatcgtgtaacgcgcgccgtcatatctcccctcccgcacgagcgtgcagcggatttcagcggtttcaccaacggagattcgcttctgaacgggcatcgtttccagagagaacgtgtacgcctgctgtatatccagcccgttgtcgcaggatgcgcataaaagacccagggcggcgatccagaccgccagggccaatatctttttcatctttttcatgtcgcttgcaagtttaatggattatgaatttcacgcccaggccgaactgcgcgtggaaatgtcccgttgtagtgccccataggatacgctcacgccccgtcagcgagaggataatcctgtcggtcaggtacgcatcgacctccagcgtgacggccccgccatagaggaaacggtcgcggtggcggagcgtagagccgtcatagagccgcctctcgccccggttcacgctctcgtaaccggccagcgccgagccgccgaggtagaagaaaaaagtcctggacgggtcggcgaggaacttgtaatagtaacctccctcggccgtgaactgcgccaccgggatacgttccgacttgtaggggtaataacggttcaggaactccgcgccgaacacccacttgtcggcattcttcgcgtagcggctcatggccagcccgaaccagtagcccgtttcgctgcggctgtcccgggtatagaagccgtcggccatgcctccccgtatttccagcccgcgcatggcgggcagggcacgctgggcgtgcgccccgtccgaaaggaggaggcataaccccagcgtgagaatgaatatcgcccgtttcatatcactttacctttaactcgttgataacacgtgcgcgcaccaggtcggcattctccaccgtgaaagtctggtgtcgcccgccttgctgctcgtgcagttccacgaccagctgcttgtcgtcggccagcgtgaacttcgggagcgtgaagaccatgcgctcggtacgcttgccgccgatgacctgcacgttgttgtacgcacgcacgggccatacgacctgctcctggatggccgtgcgtttggccaccttcttgtccgtaatcttgaacgtcaggtagtccacgttgaaaggcacgttggaggagtttttcagttggaggtggaaataaagcaggtcgttatgcacgtagatacctttgaggaggtattgtaccccgaaacgcttgcaaccgatatgcttgatctcgcggcggtcattcttgtaaatggactgcatgatcagtttgaccagcagcggagattcgcatcccaactcctgcaaatagatgtccagcgcgttattggggcggtttaccgcctccccgtcatgcaggaagtccgccatctcgaccgacagtttcaccggctcgtcggcatacttgacattgaagctgtaataggccccgtcctcggtaatgaccgaaaggttgctctcgcgcgagaaatcacgcagggccgcctttacacgcagcacgttttccgtgccgtcggctttcgccgccagaagatccgaagaccccagatcgacgtaacggatggccgaggggaaaatcacatgaacggtcttgctgaacgtcacctccagcgcgtagggcgggataacccggttgaaggtcagcggacgggtaagaccgtcgtacaaatcgcccgtggagggcttttcctgcgcgtgggcagcgaacatgcacccgataaaagcgagtgccagaagaatctttttcatactcgataaatttttgattgttgataaaaatggattttttcagtggtgtacggaagtacgtcgtttgtacccttattgaaggggcgggagcagcaggacgctgtaaccggccttgagcgtgaccttgaccgagcgcatcttcttgctcacgtattgcgacacgccctggatggcgctgcgccccaggtcggagagcagttgcgaaccggcatcgtccgtgatcgtgatactgctgcccatgcccgcgcccatattggcggcgatctccttcacggcattgagttcttccgaccccggcacgggaataccctcgttgccgttcgtgtcatagaccgacagatcgaccggaacgaccgccccgccgtgctggacagcgctgaccttgaccgtcagccgttcaccgttgatcctcgccgcccccgttacgggcgtacccgaggggatgagcagatctcccgccatcatcggttccagcagccggaaagtaacctccccgccatcggtgagcgtcacggtttgctgcacggcggcacggatactgttgcgctcgggctcgcgaaggtcgctccccaccgtgttgaaaccccagttccggggcttgacgaactcacgggcgaagaccgaatcgggcagcggggcggcaagcagcgacacgatgttacggcgcacctggcgcacgggctgcacggaagccttgccggaaacggaggctttctgacgcggggcttcaggggcctgaccgccgttcatgtagcgggcggcgatctcgtaggacttctccagcagcgccacctgctcctcctgggccgttttctgcgcctgctgttcttccaggcggcgttccagttcctcgatgcgggcctgcatctcgcgctcttcccccgtttcaccggcggtctcctcgtagaaactgcctaactggcggttgatgtcggcataggcggcacgggaagtccggaaagctcccgacgaaccgccggcagggccggaagacttatccggcacggcagcgggcatgacgggctcttcctcctcgtcctccatcccgaacgcgaaatcctgcaaggagcgcatcttttcccgctccctgcgccgcatctcctcctgcacgtaggcatcacgcttgtccgagaggataccctccgattccggggtcggcagctccgtgttgaaacccgccgaaggctcctcccgttctttttcgccgggggagaagatcagccacatgcacccggcaaaggccaggaaaaagagcgggaagaccaccatcttcttccgcatctgtatctgccggggcgtgagttcctttttccccgcctccggctgtttattctgtttttcgttcgtcgtcataattgaaatcttttagatgttttacactgtcggcctcctgccgttgtcttaattccagctccagccgctcgatatgccgtatctgcatccgttccccggctcccttgccgaagcggtagatggaagacacggtaaagtagagcgacaagacggaaaagaacaagagcagcgtgaggatcacgataatccgcttatcgggcgagagcgccccgcaagcgcggcgcaggtggtcttcgacccactccccgaaagcctttattctcttctttgccatagccttatctttttaatgtacgtaaatcgcggttctccagaatctcgaatttctccatgatgaaaccctgcgggttattgtccgaacgccccgagttgatcagctcgcagcgcgtgaccagcgaacgctcggtgatgttgctctcgcggacaatcatttgccgggcataggtcatggcccggtagggataggcgttgaagtcgcacaccacggagtccacctcgatacgctggctgatgttccccgacaccacacggttgtagtaacctttctcctgcatgtcctggtaataggcgaaggcgctcttatcgaccaggaacagcgcgcggttgatgttgctctcgatggccgcacggtcgggcgagagggtgaagaacaactcgtgaaaacgccggatatgttcgcgcgcctccacggggcggttctggctcaaatcctgcgagagcgccagcatcagcgacttgcccccgtccaggacgtagatcttctcgcgctgcttttcggcgaaacggaagctcgcgaccacgctgaacacggataccagcgcgcacaggcagaggaacacgataccgaaaagccgaatctgcctgaaacttgtttcgatgttttttaatgacttgaattccattgtccaaattgttatgaatgattattgttaccttgtgttgccaggttgcgcccgttgggggcactgcccgaagccgggccaccgccgcgacgcccgaacgtgcggccgatcatgttgccggcgataccgccagcgacacccgtggcgaatgccccggccttgttgataccgcccatagccccgccggctccgcccgactggatcacccactcggcaacggtggggatcgtgaaatagcctatgatacctataatcaaaaagataatatagacaccgctgccgctgtcgggaatgtaattggggtcttgcagggccaggacgtccgcctggagcatcaacgtctggatcttggccagcaccgcggagaacaggtcggcgatgggaagccaaaggtacacgctgatatagcgggaaatccagctcgcgagcgtcgagtggaagccgtcgtaaatggagagggcgaacgacaagggccccagaatcgacagcacgactaaaaagaatgtccgcagcgtgtcgatggtaagccccgcggcgttgaacaacaactcgaagaagtcccggacaagctgccggaaaccggccttgatgtcgtaccacgtgcgttcggcccacatgctgataatctcgcccaagtccgtgatacccatatccgcaagccgttgttcatacacctcgtcgtccactaaccaagccttgccctcgcgcctgcgggcctcggcttccaaatcgtccttctgttgctggtatgcctgcaaatccaatgtctgcccctccagtatggcgtgcgtgccctgcaccacgggcgacatcacggcgttgatcgtccccagaaccacggtgggaaagaacatcacgcacaagccgatggcgaaaggccgcaggagcgggaacacgtcgataggctccgcgctggccagtgccttccatacccggtaagccacgtaaaagagcgcacccaggccggcgatacctttcgccaccccgatcatgtcgccgcatagcggcatcatctcctgatacaggttccggagaacctggtgtaaattgtcgaaatccatgactgcctccgttttcaggttaccaatatctgtcgttcgggttcccgtaaagtgccagcacccggtgcgcgtcgcccttttcgcggctgcggatgaaggacacggagatggtcttgcgcgtgtaatagcgcgtgaggttgcggtactccagcatcttcgtgtaaacctgatccaccacgtccatccgctccttgtccgagagcgagaggccgttgccgccggttatgaccgtcttgagttccgccaccagcgcaccgccctcctccagcaatcgggcgtaacccgccgagatcgccgccagctcgtccaccgtgaagttcgggtctgaaaccatacggttgaatcccgaggtgtagatttccgtgatctcgctgaccatttcgagcgtcagcttcaccttccgggcatccttgatgatgttatgcaccgatttgagggcgtcgtagtaagccttgctctggttataaatcttgatactctcttgcagcgacttgaccatgttggtcgccgtggtcgagctttgaaccgcgctcttgatgttctgaacgaggttcgacgggtcgatgaccgtccactgcgcttttgcctggtacgtgaagcaaagaagccccacgaacagcgttaaaatcaatcgtttcatccttttcattatttaattcgtgaatacttgggcggtcattccgacgcccgataataatccccgtaggcggagagctggagcacctcgcgccccgcatcgtaggccagggcgacatacccgtagaggtcgaagtaacggatacctccccaatacttcctcacgggacgggagaagcgtgtcccgtccttgtaggacacctccacgtaaaaaccgccgccccggcgtcccgggttgcggtagatgcgaacccggggagaacccgagcggctttcccactcgcccgccacctcgtacagcgcgaagtccaaacgcgccgccgtggggtctgatccgatacacttgcgatacatggcctgccctccctttaacgtttgccctcggcgagctgcctgatcgccagttccatatcaccgcccagctccccggcaagccgctgtacctccactttctccgtttcctcggtcgtgtaggccaggtactccgggacgctgacctccgtggcatagaccgccgactgaacgccgcccagaccgatccagacctccttgtatttacgggaagggtcgttggactggttgatcgagagaatctgcgccttctccttgtcggtcagtcccaacaaggactgaatcgcgtcgaaacggttcatgaacttgcgctggtcgagcaggatcttgcagtccgagttgttgatgatcgcctccttgaccaccgggctggaaatgatgtcctcgacctcctgcgtcacaacgatggcctcaccgtagtatttgcggacggttttatacatataacgcagatattcagccatattggccgtagagagcgccttccaggcctcctcgacgatgagctgtttgcgtacccccttgagccgtctcatcttgtttatgaaagcctccatgatgataatggtgaccacgggaaaaagctccttgttttccttgatggaatccacctcgaagaccacgaagcgcttcgagagcaggtcgatgttggcccgggagttcagaaggaagtcgtagcgtccgcccttataatactgccgcagggtgatgagcatgttgtcgatgttgaaatcctcgcggctgacccggatctcccgctcctccagctcgcggcggtagtcgtcccgcaggtactcgtagaaactgtcaaaacacggcacgatattccggtcggcgcggatacgctcgatataggcgttcacggcactgcccagctcgccgctctcggtcttcgtgatcttgtcgtcctcggttttccagagtgtcagcagcagcgtcttgatgctgtccttcttctccacgtcgaaatagtagtcgtcggtgtagaacgggttgaaactgatgggatgttcctcggtataggtaaaatacacgccgtcctcacctttggtcttacgccggatcagctcgcaaagaccctggtagctgttaccggtatccaccagcacgacatgcgtgccctgctcccagtattggcggactaaatgattcataaagaatgacttgcctgaccccgagccgcctaacacgaatttattccggttggtaatgatcccttttttcatcggttcgtccgagatgtccaggtgcaggggcctgccgcttatgcggtcgcacagcttgatgccgaaaggactggacgaggatttatagttggtttcctccgtgaagaaacagaccgcgggctcgatgaacgtgtagaacgattcctcggcggggaaatcccccgcattgcccggcatacccgcccagtagagcgtggcggcatccacggtgttgtggcgcgggcggcactccatcagagcgagctggctgcccacatcattgcggatatgccggagctcctgcacgtcgtccgaccaggccagcacgttgaaatgggcccggacggattgaagaccgaacgagtgcgcctcgttgagatactggtcgatccactccttgtttatctggttcccgcgggagtagcgggaaagggactgcatgttacgcgcacgtttctcgaacatacgcaggttttcgtcgctgtcttccaggaacacgtactggttgtaaaggtggtcgcaggaaagcagaagccccacgggggccgcgaacgagagcaggcagtccgaacggtcggtggaaagacgctcgtaacgggtgtccgtacccacgcgccccggcaggtcttccgtgtccgagagcgtgtgcaggcacacccgtttgttgcccacgcgcagaacctcggcccccagctcgatgtcctgaagagaagtcgtctccgagagcgagagggaaaagtaccgctccagcaggcccggacaatccgccgtacccgtgatctcgtcccccgtgaggcggacaagggccaagaaacccgaatcgttcagaatacgctcgaactgttccgccgcctccaggaattttgtcgccgattcccggtttacctctttgggaatgatgttgccccggcagagggtcgagaagtctgaacgcatgtgcatacgctccctcgtcgttttcgtcaggtagaggaagcaggcgtgggtcaggaacggacgctcgttgaaatgccgctcgtaactgcgggagaggaaactcatgtccccctcgcccgtggccgggcggtaacgctcgcggatgaaccagtcctgcttgtgtaccacgctgtattcgggcaagaccttcagggccttgcaccaggcggcgtggatcgcctcgtactcggcggacgtgacggtgaacagctccgggagttcgacccgatagacgaccgttatgtccgcgtccttgctgatgatacaaccgccttccacggccaggagcgggaacttgctttccagcgtggtggctttcaagaggtttctcatacgcggcccccctttcttttcagcaaccggcgcagggacttgcggttgagcaggtagcggggatgccggcgcgcggcgagcagcttcatcagcccgtgttccccgtaacgggtgttcaggcggaaggtaagccagaccagcaccgaagccgccgcaacgccgaaagcgatacatacccactgatcgacccctgccatgtagaggatgacgaacaccacgaagacggccagcaggccgcccgcgaagatgaagaggtactgcgccttcaggccccggaactccacgctcttgccgattcccttgttgattccatattccataattatttgcatgacaggttggactacaagaagaaagagcgtaggatcgtcgcggcgacaatcaggaaaatacacgcgccgaaccagctcgcggcggtcttcgacgtgtcggggtcgccgctcgaaaacttgttatagaccttgatgcccccgataaggccgaccacagcccccacagcgtacacgagtttcgtgccggggtcgaagtagctggttaccatgttggtagcctccgtaatgccggcgatgccgttgccctgcgcgaaagcggaggagatggcggcaaagagaaatgccgccggaagaagaatcttgttctttctcataactcgataatgtttgaattgtggcgcggggatggataggccccgcaccgggttaaacttcttgattcgttttttttcagtggttcgaggatagcctcacgcgctacccgtagtctttttctttcatcgtgatgtcattatggggttaaacaaactcacggacgtcgaaacccgtgggaaccgaaccctgcggagatgggctttccgcagacctctcggacatacgccggtgaaaagccgagaggtaggtgtcgatcagggattttaccctgtcgttcccgtcggggcagcccgaaacgatgacctcgaacatgtcggtctgtttcaggcccaggaggacacgtcccgtttcctccctttgctcgtctgttgaaggtggatcgtgtaccacgtggcggtaggcttcgcccatctgttcaaaactaaccccctgggcaagcgagcggcccaaaaggggcagctcttcggtgtcgtcttcatcctcgtcataatccggctcctccgcgtccgcatccgggaaagattcatcgtacagcggaaagtcgatttccagaggttcgttaggctccccctcgggagcgacaccgaacacttcatccaggtcttccggcggaatctgccgggggtgttcgggtacattcgtgggcacaaatatatcggctttttccgtaactttttcagtttcagattctacggcagcttgtggccgggagtggcgcaagtcgaggacaaagcggctcctgccgatgatctcctgccggcagggcgtgtcttcggcaacgatcccgtctgccggttcgttacgttccatccgccgcaggcggaaaaacgcccacaaggcataccccacggcaaagaggggcagcagccacaacgccccgttcatcgctcctccgctttgggttgccgggaggccacggcctcacgctcctcgaaaagccgctcgatggtttcccggttatcgtccaggtgcgccttgagaaccttgtccacgtaggccgtgatcgtcacgtcgccacgaccgatgacacgggtgatctcgcggatacgctcgtgatacgacggacgtatcttcacgtgcttgttaccggcgaaaggcagccgcagcaggcagatgtaacgggccaggtactcggcctcgggggtggggacagtccccacggcgacctcccccgaagggccgtcggggacgataagggttttcatcctgcgccggtagcggcacacgcggaagatgaagggcacggcgacgcaaaggacggccgccaggataacagataaaataattgctttgtctgacatgatggattgtttttaatgggttgtaaatattgggttcataactaaaaaatatcggagttccgtttcttgtagagttccgaaatttcctcctgataggtcgcgaaatgctgctccagcacattgtccaggtagctatacagcgagagttcgttcttaccgataacctgcactatccgggttatacgctcgtgaaactccttgcggatatacaccgttttgccgcttcgggtattggagggggcgttccggataaaaagacgctcgtaatcctggcctttccctcttcggcggcgtccctcctctttcgtagccgacgaggaggcggcctcgccggacggttccgatagagccgatgcctcctcctctttttccggcgtgtaaggatgtaatggccggtttcggcttttggcctggctgatgatgaaggaagcgtccaaaccgtcgtcatgttcttttccgctcatgagatcctactttaacagttcgatcaattcatccacgagtttatccaggttgctgccccggatcaaagaacggtctgccgggaagagcgtggagcggaagacagagcgacggctggcgttctgctcacgacgaaaacgcttggtgtcaggcaagaaggtcttcaggacaggaagatccagctctttcattaccgcctcgtaaacctgatataattctgtcttttcacgtccgtccaccatgttccatagcatatacagccctttcatccgggacttctcgcggcccatgatatgctcctttaccacaaccgcgtaattcagggtgctttccatgacaacccggtcggcactgatcggggcgacgagataatccattccggccagggaatgaatcagatcctcgttattgatcgtaccgggaaggtcgaagaacacataatcgaaatcaccttgcggcaggaggtagtcggcatcggccaacgcctctttcgtgttgctttccacgacaggataggctttcttttgaagccgggtgaattgttcgtaagctaacctcttgtaatgttcgtcttcgagggcaagcttcaggtcacgttcccgcatctccacgatggagtgttggggataatcgcagtcgatgaccgcgacattgaaaccctttacatagtgcaggtaagaggctgccagcaccgtgagggtggttttgcccgctccgcctttctgggtggagaaggccacgaatttcgttttctctttcattgttccatgcgtttttagttatacaatcgggtaatcgttcatctcttcacgtatccgggcaagtgagggcatgagattttatgcaggtatgccggcacgcatatatgctggtgcgctggcaggctgttacgccggtatgccggtgcatgggcgcgtgtccgattttatactcatgcgcaaccgcatttgcttatccggacaaagacccgctttttcctctgcacacggtgttttctgcatccgtccgcacgtgtgcggacagggggatgtgtcattgcccgtatccgttctcacgtgcaaagtaaacccttaaaaacacgggttgtatgctctttttccgctatggccgcgtgtggcgtcaaagtggacgcaagtggcgtaatcgcttatgacacaagtgattgaataggtaggtatctttgcctcgtgaacgatcccgacgctaatgaagccgtccttgccccgttttacggcggctctttcaatgttctgtccgcgagcgggcagaaggtatttgcaaagggcaaatagcaagctgtgttttctgctgcacgattctcgttttgcagcagaaaacagcttgcccgcaagggggagaaagcacctccggagtcggtgcttttcagaaaggcggcaagccgcgaagggatcggaattttcaggaaccggtggggccctggcctctccttaaaatttcgatgcgatggaaaagaacagaaagccccgagggggcaaagggggacgacccgcgaaaaacgacccggccgtttaccgcttttcggtaaacttttcagccgtggaacatgcccgtttcctcgacctttacgagcagtccgggctattgtccaaagccgcttttatcaaagcgagagtgttcaacgaggcgttccgggtggtaaagaccgaccggggaacgctcgaatacgtggcgaagctgaccgctttccacgcccaattccgtgccgtgggaacgaattacaaccaggtggtgaaggagctgcacgcgcatttttccgagaagaaaacactcgcgctgctctataaactggagagagcgacacgtgaactggcggccgtcgggcagcaggtcgtgtcgctctccgaagagttcaaacaacgatggtagccaatatcaccaccggaaaagacgtgtacggcgcgctggcgtacaaccaggagaaagtcgatcggggcgacgggaaggtactgctgacccacatcgtgagggagccggcggatgggcgcttcaacgtggccgcgacggcagaagacctcctgcgctggatgccctcgcactaccggacggaaaaacccgtcgtgcacgtgtcgctcaacccggctcccgaagaccgcctcgacgacgggcaactcgcggagatagccggggcctacatggagcgcatgggttggggaggacaaccttatatcgtattcaagcataccgacatcggacgggagcatatccatatcgtgtcggtgcaggtggcccaggacgggcgcaagataaacgacagcaggcgcaacgaacacagcgtggccgttaccgaggaactggaacgggagtacggactgcatcccgccaaagggagaaggcgggagaaagggcaagggatcgtccccgccgattacacgcggggcgacctgaaacgccaggtggcagcggtaataaaaccggccgtggcgacataccgcttccaaaccctcggcgagttccgggcattgctgtccttatataatataggtatagaggaagtccggggagagcggaacggaaccccctaccggggattgctctacacgctgctggacgagaacggggacaaggcagtggccgcgccgctcaaatcctcactgttcggtaaagaggtcgggtatgacgggctggaacggcacatggagcgcagcgccgaacggttcgggaaggacgacacgaggaggcaaatccgtggccgggtcgataaagcgcttcggggagaacccacggaggaagaactgcgcgaacgcctgcgggaagcccgagtggatctctacatacgacgcaacgaaaacggccgcatcgtgggtgtgaccttcattgaccacgaaacacggacggtcgtgaacggatcacggctgggaaaggcatactcggccaacgccttcgagctgcgcttcggcgggaaacggaatcccggggaaaacacgagggacttgtccccgaaacaagcgcctgccggacgggacgggcaacggaagcggaatacctcacgacggaggaaagtataacatctcaattatcattcatttattaaattttacggttatgcaacaggaagacgaccttcggggtcttgcaaaaacaatggatttcatgcgggcattgagtatcttgttcgtggttatcaacatctactggttctgttacgggcagatacgggaatggggaatcaatatcggcgtggtcgataggattctgctgaacttcgaccgcaccgcggggctgttccggaatatactatggacgaaacttttcgccgtcgtgttcctcgccctttcatgcctcgggacaaaaggagtaaaagaggagaaaattacctggcggaaaatcacggcatcgctggccacgggaggcgtgctgttcttcttcaactggtggctgctggacttgccgctgacggcgatggcgaacgcggctttctacatactgaccctatcggccgggtatatctgcctcttgatgggcggcgtgtggatgtcccgcctgctgaagaacaatctcatggatgaccctttcaacaacgagaacgaatcattccagcaggaaacacgcctgatcgagaacgagtactccataaatctgccgacgaaattttactataacaaacagtggaacaacgggttcgccaatgtcgtaaacccgcaaagggcttgcatctgcatgggaagcccgggcagcggaaagagttattgtgttgtaaaccagttcattaaacagcaaatcgaaaagggctatacccaatacatctatgactacaagtttcccgatctttcggaaatcgcttacaaccacctgctgaatcaccagaaaggttacaagaaaatcccgactttctacgtcataaatttcgacgacccgcgccgctcgcaccgctgtaaccccattcacccggacttcatgaccgatatttcggacgcctacgagagcgcctataccatcatgctcaacctgaaccgaagctgggtgcagaagcagggcgatttttttgtggaaagccccattatccttttcgcggccgtgatctggttcctgcgcatctacgacaacgggcggtattgtaccttcccgcacgccatcgagttcctgaacaagcggtacgaggatattttcccgattctgacatcctacccggaactcgaaaactacctcagcccctttatggatgcctggctcggaggcgctcaagaccagctccagggccagatagcatcggccaaaattccgctttcccgcatgatttcgccccagctatattgggtcatgtcgggcgacgatttcacgctcgacatcaataacccggacgatcccaagatactctgcgtggggaacaatcccgacaggcaaaacatttacggagcggctttgggattgtataattcccggattgtcaagctcataaataagaaaggccagctcaaatcgggcatcatcatcgacgagctgccgacaatctacttcaagggactcgacaacctgatcgccacggccagaagcaacaaggtcgccgtgctgctgtgcttccaggatttttcacagttgaagagggactacggggacaaggaggccgccgtcgtgatgaacacggtgggcaacatcttctccgggcaggtcgtaggtgaaacggccaagacactctcggaacggttcggtaaggtattgcagaagcggcagagcatgacgttgagccgcagcgacaaatcgacatccatatccacgcagctggacagcctgatcccggcctcgaagatctcgacgctcacgcagggaatgttcgtcggggccgtggcggacaatttcgacgaacgtatcgagcagaagattttccactgcgagattgtcgtggacaacgaaaaagtgaaagcggaaacggcccggcacaagaagataccacaaattaccgacttcacggacgagaacgggacggatcacatgaaacaggtcgtgcaggaaaactacgaacgtatcaaggcagaggccggccgcatcgtcgccgaggaactggaacgtatcaagaacgacccggtgctttgcaagctcctgccggaacagaactaaatgaacacaaacacccccgcaaacaacctccgtgaccttaacgggggctgtttcctgattttataaccgcacagccggtgttttggagcataaagtagtgattatgtgaacggaaaacattatttttgtgttcggaatccttttaattataagtatgacagttaccgatatatacgaagcaatgaacagcaaggcggaagcgtttttcgagtggttgcaggctcacccgaaatacgggttgctgtttggtgtcgggttgcttgccctatggcttgcagggttgctgttccgttggaaatgggcatgtcattggcagtttaacagcaaactgtggttatttgacgattgcaagcctgaaacacgccgcagggttcagattgtgttggtcagcgttctgattatacttatattggtcgatttctttgtatggagataacggtatggaaaaggacaatcgcaaataccggatctgcttcatcgactatatgtggtatgtagccgagatatggcacgaaagggagcgtaccaatctcaacggacgtatgctactgttttggtgctggctcttcgtcctactcataccgcttgggtttccaccgatattgcgccttttcggctggatgattggtttggccatagtgattcctctatgctttcttcccgatttattctgcaagctacgctatacagccggacggcgtgaagcgctccgtgaacattacgggaagatgaaacatcccggcaggaagctcgccaaaatagttcttatcgctatcgccctgatcgtggcaaatgtagcgctgatgttccacctcggatttatacataagccatgatgaaaccacaggaacataaacggcgcttttatctctgggactacctttggtggatgggggagaaatggaagcaggcaagacgaacaggcagggtcgatggcgaaatgatgctctcgatttatagcttcgctcttttgatattccctatgatgactgttactatccggctttttccaggtgtgtcggcattgttgccatgtgtcgtttttagcattgtcacatttgccgttatgtcgctcgtcagcaggatttacaaatggcgaggcaaagcagtgatgtctcactatgccaagtgcaggtttaacgaactccttgcggttctgttatttttccttgcgatggccattatctgctttatgatgtatcttcttgacaaaaagtgatacatactttgatacggactccgggccgttatatcgaatggtctaactcgatgtaccagtttcccttgatgggcttgtaaagcgtggtgtcgttgtacgtcctgcggtagatctcgttcaggtcgccatgttcggtgatacggatattccgacggcttctcaatccgggatcgtaaacgaaactcttggacgttccggcatccacgatgccgtgggagtagtacggcataacgaggctcacatataccgaatctgccgttccccattccctgcgatcaacaaggataaaaccgcatccaatctctgataacagggagtcgagtaggattcgctccggcttcaacagtccatataccgggatgtcttgttcatcattcgtttcatgggatgtatcgctttgctccattgaatcaagtataataacctcttccggagaaagcggcgggtagtgaaaactaccttctgaactctctgccatgatttcgtacaccttacggaacgccacctcgtgcgtggtgaaatggcgtatcatttcctcgtccgacggcggcatgggaggctctccgcagcttacggcaagcaggattacaaataacaggattatgactggtgttctcattttctaatgtttaatgttctgtggctaaccaatcttgtttagggagttgagccatttgttaatagcatccaatctgttattctgtttaatggtatcttcatttctacataatttgatttgccgaataacagagttctgcataattgaatcggatttgaaaagcagttctaaaacggcttcataacatttggaatatctggacaattcatccaatatatttgcgtcttttagaatatacaggttgaaattgtacacaaatgacttgtaactgaaaatctccgactgtaatgctgctgcatcaagacaagtataaaacaattccttatcgtgctgatatagccacatataatcagatgggttcaggttgtagtgcaataaagtttccgaacggacaaatggaagccccgtatttgagcctaccagataacggtatgtctcattgactattgactcaactatttcaatggattctgattgtttgtccgattcccgtatttctgtaaatgtatcggcaataagaacttccacatcctgcgatttgtaatatataccgtttttttgccagcggaatctacggatatattcttcagaagtcggacaacagaacagtaaagtatttaacaatcggttcagatatattcgcttatctggaatatgacaacggtgtaaccctattatggagccataagcgtatagctttccaaactcgttttcctccgaatttgaatttttaggcatgtaatacaaccgcacaatattggaaatgaaataatatatatcaagatatttcaatgtatcagccgattctccatatttgttaagtaaatgccgctccagtttctcgccataccataagtagccatcgggatttatttgaaacaaccgatgaaacttaggtcttgataatgaaaagttcttgtttctacttttcattcgttccagtaaggcgacaataattctattcgttatatccatagctgtaatgttcaatagcgttccgctttaagcagtagtgctgtttgttactaacgaattcattcattaattgatgctttcattttttctacaattacatcaatatattgttgtggaatgtttttatttttatagttctcaatagcatcaagaatactttgtttcaatatctcaacacattgagaatcatttgctgtttcaaatttatcaaatgggagtagaatttccaattctatccgattacgttttttcgaatatcgacttaatggatttgtagtaaatccttttaagcagaatacatagaaacttagttcattaatatatgaaatatcacatagacaatccatatattctattacagagtttcttgctttacgaaacttatcagaaatactatgttccaattcacctccaataaaaactttcatacaaatttgttatcgttagtaatgtccggcagcgttccgcctttgttcagtcgggttgcagcttgttagcatcgttttttatttacggtttttatacttgtttctcagaaatcccgtagttcttcgaatctatccagcaatcttgccttatcaattattggattattcatgtagtcaattattgaacacaatacctcgtataccagatcccgttcatcagtttcgatacatctcattcgattaaatgtctttgtatattcctctaccgcagcaattgctttagtctgcgcctccggatcattttgaacattcagggcgagtaactcgtttcgtgtcttcctgtactggataatggcctttttggcggaggagggtgagatataatcactgtcatcccaatctctgaatggattatccatattttcttttatccactctggttttcttgcctgcgtgacggaaagattcattccttcgttttttcgcttcttgtataatttttttatacattttgccgcatcttctggcaaacttgtcatccaaagccagtttagatgttccatccgttctggcacaggaatatcctctgaactgaagccaaaaagattcctcgttgcgaaaacttcaatgttcctaaaactttcgagtaccgagaagtttctgatatacccgggttttccccataaccagagttctttcagattagggtaaacggagaatatatcgttcatatccacttcattaatttctatgccatgaagactgttgagattggaaagttcaggataggggtgaaatattttacggtattgtaagagaaggttagccccgttatctcttgcatgaatgacacatggactaattttatcattcaaaagatataactgttccatttcatcattcaaccatagttcatcaatttcagtcaaatctatgagaagttttcgtaggcttgtaccacgaaaatcaagacttctttgtcctttacccttatatgtcagttctgtaataaacggtgtattatccaaatattcaatgagcccctgatgatattctttaagaaccagcgtagaaagacatgggaatacttttaattcatctgctttggaaaacgggcaatgggcgtcatctacatagtgcgaacttattttatattcagttccattaagccatactgtttcctcacttttcattgcaatcttaaacgcttttctcctttcttcaggaatctgttgccatttaatttgcctatatacatcatacccataattccctgtaccaaaatatgagttttcctcgtttgtaagaggaggaatattacctacaaatataaaataagctggaacatctatatcgacattggctatacataattgcctctcccaatacatgaaatccatataaagaggttggagattttccatctgtactagatgaagaggcgattctccagtccaatccaggtaaagacaaattgcgtcgcccttatcctctattacgtttgtaatctgacaggctgtataaagccttaaacgattattatagatagtatagacatctcctatctttgctttcatattggtttaattataatttttcgatgctaatggtttgcagcgttccgccttattcagtcggtagtgctgtttgttataaactcttttttctttattcttttgccgttacatgtaaagccataagtaaaagctgcatctatggcttgttttgcactctcaagaatataatgatacaaattatcatatttactaaagcatggagaaagaatgtagaagtttttaatatttaaaggaatataaatccccgtcatatcggatattccatagcgtgcttcctccaaatttggtactggtatggaaatagatatttcaaactctttattagatgggaaacgttttgcccgtttgaaaatcccaatccccccattagtatttcgaagatttatctgtatgagaagtttccaatctcccaaatcatctaagttgatttggttattgtaatcttccatataaccattcaactctcggtaaattgagcgcagtaagtccaattctccaagttcggggatttcactacttattaaaactgcatattgattattcatacattcatccttatatccagagtttataatgtttagcagataaactgccttaaatgtttcatctgtttgttagcaatcttttaagaaagcaacatgaagtgccattctttaggatagtccttctttatcatattgaacagcaactttacattattggaatgctgttttgtcaatatggagtatatatattcatgacaggcgcagcaggctcgttctttattagaagcaacacaatgaaaagaatcatctgtattttcctctacacaaaaccagttccatccatagtgcttttggatggtgtttcctaacagggaacctaactcataagccctatccgtaatttcctcgtcatctgaactttcaaaattattgagatagttctttatgccatcaaggatggcagaggattcagcactttcctgcaaacctataaggactaaacctttagccgcaagctgatctatttctattcgttcgtcctcattaattggacggtattctataatttcactcattgctttctttttttcgtcaattgctaatgtccggcagcgttccgcttattcagtcggtctgctgtttgttatcaacttatattttgtctgacaacaccatgttcataagccaaactatcacattctttttgcatattggtcagaacatcttcgaccacttttaaggaaacttcttgtggtacatttatggatacgaatgaagggagattagaaatctctaccttgcatcccatatcaagtagtttgtctctgaccatctgcatacgtttatcgttaaaatgtaccctcaatgtgctatttccagagggattcactatggattgaaaatgatattcgccatcttcttctgtaacacatatctcatcccccaaactgattccataggtatagaatggcacattatcgacaatataagtatcattacttgcctttttgcaccacaaaccttcaatagaaaatggtggatagccatcttcatcttgttccaagtgaaatagcacttttatatgtttgtcttttttcattttattcattaataagttgataatgttcggtggataatcatcattaaaggagattgatccgcttgttatctgcccgctttattcctcttcttcgataaaatgatttataaagtaattgaatgactgggcgatgtaacgagtatttgtttcaaagttgtattctcttgaagcgttttcgtcccactcgtcagtcaagtaatagtaaatctttttattcttcaagttcaacgcataatagtttccacccgaatccatagcaaaaggcaacagattgcatggcattaaattcctactccatatatctttggctatgacttcaattgtttcaaaagcattggtgcgttcctttatcggaaagaacgcatttatctccacccgatccaaatcctcgtcctgcggttgataacaatatggtgatggcataccaccgttgaacttgaggtaaaagttcttcatgcctgccggaatctttacattcaactcaacctcaaaattctttatatcttcttttgttagcgaagccgaacagtccgaaagttcaggcattacacctgctgtctccgtttgtccctcttcgatttcttctattgctggaattgctttgtgcccgtccaaaacaacgagattgtcaaagaaatcatctattgaatttgcaacaagtcgtggctctccaaaattgaagattacatcttgcatccccacaatagggtaaagatagatctttccattaaccaagtctatggtaatccgaccttcatcggtagattccatagcaaaaataagaatgctatcagatatagctccagcttttcttaactctaatgtttcgccttctgccgtatatctggggtcattcttaaaatccttgttatatttgaatgggaagaaatcttcaatttccacctcttgatatttatttatgcttgcggtctgtttcgtagaacctccattatattgtaaatagaactctttcagtctttccggcaaggcataacccaatttactctctatttcttcaaaatctttgagagtaagacttttttggcaattttctaattctattttcatattcattctttttatgggcagataatgtttggtggataaccgaccatttcgagagcaattaatccgcttttatctgcccattctattcttctcattgttcaaaatggatattattctctgcgacatatttcttaatcggctcaactatatcggtaacgtagtttgtgcacttaaaaaattctctaaatatccaacctccttcacttgctttggctaatggaaccaaagtttcttcaatgaactcttcatggttgcacaagagagaacagattactcctaagctaaactgtttatctgcatatatatgctgaatatgacccgaatttgagtaaaaatctataatttttgtatattgtttgacaaaaggtatgatatacggaaaaaaatcctttttcaaatcgtttaagaatctctcaacgttaggagtcttgtcactcttattcccgaaaaaataatccatatccattagatgctgcttaaaccaatcaatattattatcaaagcaaactatgatgttaccaccagcgtcttttttatttaatggttctgatacaagactacataaatatggattctttattttagctgatacacccatacaaaaagtgtttttaccggcatatccaccttgggttgtttgaaagtaaaactcaatactacaatcgttttccactatgtaagtaaagtagtctttattcttttttgctttgaccacatttacaggaagcatctcttgtattcttgtaaacatgtattttaggacttccgctttagtttccatatcactttttttagttcatattattgggcagataatgttcggcggataaaccaccttaaaagtttcatctgtttgttatcgacctattttatttttagtttttgactatatgcaagtattacaaaacgattatctaatccacaatcaattacatcattcttttctaattgagaataggcttttacaaatctatttcgacatttacttgaatgtatgtaatgattgaagtagttctcggcttgttccttttcaccatatctcaacatatatggcagggcaaggagagagtctttcgtgtattgattgaaacaacagccatgttgcgtaatgaagtcaatagccatttgtctattctcaaataaatcaaatatcggacaagcatatttttcaagtaaatcaattattgtttttattgatggagcatagcttagtccggcaagatcccaagattgatattgatttattggcgataggtatccaatatgattatgatatactaagccatcatcattgacattgagattctcttcttgcacccactttttcaagtttttacaggtaatcgtaatcagtggatatatagccacactacaagatgaattatatacacttgaacgaaaccatatttcaaaagtcaaatttttgtcttttgaaatctttttcaaacattgtccatttttagacggcttaaatcccattgcgataaaaggaatagctatctcattgcaggctttaataaatatatctcttggtttcatttcttgttcttttcaggtcgataatgtttggcagcgttccacttattcagtcggtttgctgtttgttatcaaattctcatttatccatttatttacttttttcgttacaaatgacattggagaaacacctgaattattattcactgttatatctgcaccattttccaataatgtaatcgcagatttgtcatttctatcaaaaatggcaatgaatagcggggtacgaccattttcttcttggatatttaagtttgcctttgaccctgcaagaagttctataatttccgggctattctcttgagcagcgaaatgcaacgccgtccacccagagtcatcttgcaaatccaaattcaaaccattcattttgtattgctttattagttcaatggcaaacgtactctttccttcgacaatgaaattcattaatagatttcttccatctctatccacaaaatcacatccatacttatccacaaatgatatgacttttgtaaaatcatcttcgtcgaataattcaaacatcagatcttctgctttttcgttatattttgtactcataactgctttattttagaatttgataatgttcggcagctaatcgccattttgggcgattaaggtgtatgttagcatcacttctaataaaagaatcacatatcagctaatttccactttacttcagaagctgatacatcatcatcaatatatgcttgcaaataagcagctaaatctttatatcgactttcaccgttgcaatcatatacccataattccggttcttctgtaccgtcaaaccatattaggcaaatcatttcatagccattatcgcttgctgcaaaaatggaaattctgtttggcgcaaatagtccagtagcatggtcttcccaataatcctttgaagcttttatgtcgcgaacaattcctatcaaccgttcatccttttcatcttcattccatggactttccatttcttttgtatcaagccaatctccatgtgtcgcattaatccatttaccaaatgccccatacctgattttcaacataggagagacatttctataaactcctttttcaagggtaggcactcccttatgaaagtcgatagcttggcttatttgaaccttaccttctaaatcaatgacttcatcaagcaattcttttattgttttcattcttttttatttgatgctaatgtccggtggctaaccgaccttttcaggggagggtaagccgcttgttatgtatctttataagttgggatgacttacccaattatattttttcattaacttttccattgctttattctctgcattattatttctgaaataaatatatacagatttcaaggttttcagatgaaataatgttttttccaactcttcggttgttagacatgttagttccgttgcgacaaaacgctgcaatttcggaagatatctgacactgtctataccatagcgcagattcgggcagcctgccaactccaacaattccaagttgctcagttttgacaagtctggcaaggtctcaagactgaaagtccagtgcagataaagtcttttcagattaaccaatttagatatccacgaaaaatccgagcatttcgtctgccttttcagatacagatattccaaattcggaaatttgtcaggcaaacactccccgtttgtcagtttggagaatatggataactttttcatattgaagttaggattcagactcgatgcgtccatttttttgacctccaattctttaagatttgtcaaactgttaatgacagaaagttgttttttagtaatttccaaatagtctccaaaattaagagcatctaagaactttaactcttgcaggctctgcaatgatatgcttcttttaatcagacctaaaattgaaagactttgcagtaatggagtatattgaacaaaatcaatagaatccaattctgctttatgcggaaagttggagacaagtaaatgccgtacattactcaaaaattcaataatattgagattgtatatcaaatcttcatcttcttgacttattcctaaatcacaatcaatacatatcatacaatcattcattccaagcaatttattaatggattgcaattgactcacagtatatccctgtgtaccagataattgtattgattctccttgtactatggttatatttgcaatttcctgtgaagtttgtttacgaatatatatcatattgaattttattaagatacataatgtatttcagctaactgcatttagctgttaagttgattgttaccaacatttattttttcaattctcccaataagcatatattggctatgtgatattaaatattcttcatttttttcttcgtatttattttctaaacacaaagcaccaccgacaataacatcaacattcgtttctaaatcaaaatattctttttcatatctgggtttcaaaattagaatacaacttttttgtccattaaaatctaaaaaactatcagatttgaaaagaagaaatgtaggagaaagttgctttattactataccatgaagaatattactaccattatgattgaaaccccacggttcatctactgttagtttgtacttgaccatatttattaattttctttagttggtaatgtttgtcagcgttccgcttattcagtcggtctgctgtttgttatcaatgccttaccgattataaagttgatttagcattttgaaataatcatttccaaacccttcaacataatcatccattacgccatatatgttgtttttactatcaacaagcaagaccatatatccatgttcgtattccccaaaaggacaaatatccgaaacatggagtagttcacaaaattggtcgtagaataagtaatgcggattatcgtttaatgttttctttaaattaaaatgcacatccacttttggaaactgaaattcctgattgtagaaataaataaggaaatctatcaactttgaagtcggttggtagtttgctttagaataaattgccacaagctcattcgggcttatgattacccgattttcccagtggcaattcgttttaagatattgcttcagttccatactacttttattttttattttgcacattgataatgtttggcagcgttccgctttttagtcggtttgctgtttgttagtcgcttattcccattcaaatgttgataagtaacgaagaccattatagtccgcaatctcttcaacatattttttaggtatgccaagatgacctttcatgttttctttaagaataaaaactttttggtttttctttttatctctaaaaccattcgggatatagcagaaagtacaattatttgaggcattattaaggccatttctatttaatgatttttcaacccaacaatcaagtacattattgtctattataactgattgaattaattgaacagaattcattgtacatgttttgtcaattttaattcttaaaaactctggataatagaattttatacctaagtctttacagaactgacaacgatgttcgggattgggacgctttttgctctgaccggattcatacgcttccaactccttgaggtattgctcttgattaaaatactccataaattcggtttcatttttatcggtatgcccaatccatgtcatatatttcaaaccggcagtcgaggctgttgtaccagtcggattaagttcaaaaataaaagagcccaagaaggataccgatacggtattcgtcgctttctgcaatgatataccctcatggctattatacatgattgccgcatttgcgacagttatttttttcgctcttagtatttccttgattttatctgtgtctgccggaataacattcaacagattctcaagtccttcagaagaatatttcataataagagaatcttcgtcatagtccattacaccaagctctttacagaactggcaacgaagttccttattgtcttcatcgtattctttccaccattgacggaaagccgattgatccatatatttctcaaagtcagcttcggaatcgaattgaccgacccatatcattatcttgctcattttctttttttatttttcaagcgactaatggtttgcagcttgccgccgtgaggtggcacaggtgcttgttatcagtcacttttatttcaaatcttctttatttatagtaattattctattcggtataaagaattgagatgcttccacatctatgctgtttgatatatagcacttccaaaatttcacgtatagaaatttctttttgattttacgaaaaaacttggaaaccatttgagaaaaatcattattatcagaacagcaataaaaacgtccagcaatgtatgccatatcttccctttgaaaaggaactctatattctaaaactggacttttcacatagtccaatacttcagctgttgttccatcataatattcatgtgtataatatgatatatattgttggaaagattttccggtcaaatacatcttccggtcattagcacaaatgtcaaaaggagataaatctcctttataatgtgggacacacaacaactctccaaatacacttctaagcgtatttgcaatcatctcatcatcatttttatgcgaatagaattcaaattgctttcccatgttctactggttttaatgactgataatgtctggtggataatcatcattaaatgagattgatccgcttgttatccgtctcattccttttttaatgatgaaataaacgattcaaaatcactcgccaataaggaaagagctacttcttccatttccaagaaatagattttaccttcagctttgtcaaaaacgaaataattgccgaatggatctatagcaaatggtattacagtattcgggattatatcactcaaatcagttattgtcgccgaatacgtcaagtcttcaaattctgtggactttatgggcagaaagaaatccaccacataatcctgactattttgagtgtatatcgttttatttggttgacctccgttattggcaagaaggaacgatttgatttcctgcgggaaaataaatttgtttttccgctcaacatcagctatatccttagctgtaattgattctgatttattgttaaattcaagttccattttattttttattttgacggataacgttatactatcagccgatttggctgttattttctttaagtatcagacctcgtcttcctccatcaacagatcgtccaacgggcttttgatattgcttttgaaagtgtcggctatgtggacatacctttccgttgtcttgatgttgttatgtcccataagctctttcacaatcttgatgtcggttccttgctccagcaagtgggtggcgaacgaatggcgcagcaggtgcggataaatccgtttcgtgattcccgcttcccgggccgctgccttcagccgtttcgacacgatactctcggtgaaaggttcgcccggtctgtgttcaaagagccacactttcggtttgtatagtctgttatattccgtcagctttttcatcaacggttttgatagcagggtgtagcggtctttttttcctttaccctgccgcacccgtatcagggagcgggattcgttgatgtcgccgggtttcagttccagcagttcgctgatgcgcaatcctgcggaatagagtatggagaacatacagaagaaacgcaggtctgtcaccgtcacgtcgagtattttctttatttcctccttgctcaacacgtcgggcagcgtcttctcccgtttggcacggttcaccttgtaacaccgccgttcctgaccgagaactttctcgtaatagaacttgatggcgttgatacgctggttttgctggcaggaggatatgtttttctcgtggatgagatacagcaggtagtcgtttatctcgccgggagtaaccgtttcaatcttacgcccctcgaaatgctgttggaaatcgcggaaataggaggtatatacccttacggtatggtcactgtaacgcacttgctgaagtttttccagatagccttccggcagtggcggccgtttgtcttcctctttacggggtgcggtttccttgatggcagaatagtctataaacgccatttttacatagcggtcgaagaactcggcaagcacgaaatcttctgccggcagataagccctgccgccgacaagcagtacgttttcttccttcgacagcgacaagcggatgtcattgtcattaccgaaagtcacttcgacaaattctctcccgtttcttatcaccggagaaagtttgatcttggtttttggggtatatatttccatgcctcacgttttgtcggatattgaaacccgttttcgcaaatttataaaaaaacacgggttatccatgcgctttattgacatttaacaatagatcccgactacctgacaaataaggtgaggagccacgaaaataccctctgccaaatccgtccttcccggcactccgtttctccgatttcctctgccctgcgccacaagcggccacttctgtgcccgatgcttccatagcctttccaactcttttacgttcagccggttccccttactttcgttcccgcatcgctattggtgctaactaaaaacactcgtaattatggacgaaaacgtaaagaacgacgctaaacaagtcatgctcgttcagaatgccgacgacggacgactacaagccgttaccggcgtggatcaggacggcaatatccagaccgccgaccccacggatcagaacgtggcgagcctgctgaacgtgaacacgcaggattcagccctcgaagccttcttcaaaaagttcatggaacaggcccagaaccccgtccacacgggtatcttcgtcatgacggagaatgccctgaacaaacttatccgcatcgacttcgacccggagattctggaaaattaccgtatcgacccctccgaacggctccagacgcaggagcagcggcagttcgagccgctggacgtcacgaagatagacctggcggatatggagaagaaaggtatccgcatggaggacatcgagccgcacctgaaagccatgtcttacggacataaatccaacgggctggtggagatgaaccccgaactggagaacgggatgcgtgtttccaccaaagggcgcgtgtcgctcgaagagcaggcggacggctcgctgcgcgtcgtgccgcattactggcaggaacgacccgacctcgacgcccccttccacggggtgctgctcgatgaggaggcgaaaacgaacctgatgaacacccgtcatgccgggaaagtgatcgacctggagctggagccgggcaagctcacgccctgctacgtgtcgatagacaaatggacgaacacgctggaacccatgcccgtttcgttactcgaaaaacgtgcccgcatcaaggaggccgacctctcggaaggcaagcagatggatttctacggcggcggcaaggtgttgctcgaaggatataccacccgcgcgggttataagcgggatgcctatatccaaatcgacgcggccgaacgtaactattcctttacctacgacggtttggatcgcaaccgctacgcccaggagaacaaggagatttaccgccagaaggccgccgagaaaaacggacggcaggaaactacggcctccgaacgacagcccacgctcacgattcaccggacaatcctcaaagcctccgtgcccaaagaggcttatgaccagtggacggaagcggtgaatgatccctccaagcgggcggatgtcaaggctttctacatcaagggcatggtcaaggacgggcagggtgagccgttcaacgcctgggtcaagcccaacttcgagcgtaacaagatggacttcttccgctggaatcccgaccgtgcgaaacggcagggggcggaggtcaaacccgccgttgaaagccgtacccaggtcgccgtcaattccgagggcaagaccgtcgaagcggtcaaaggtgtgaaagagccgctcaagcagggacagcaggaggccaccccggcgcagaagaaaaattaccgcagcagcaaaaagagcaactccaaaggtgccaaggtataacgtatgaaatggttctacatgcaggccggagccatgccgctcctgatcgcggcgctggctgccttgtacctccggccgggtaaacgcagccccccggagaaggcggacgacggacggctgtattacgacgggaacggcaaccatgtctattacgaccgccggctgatcgcccgtccggaaaaagagaaagaagaagaacaacaagaaaacaaccactgaaaaatccgaatcatcatgcaagtaattatcgcagaaaagccctcggtggcgcgtgagatcgccgccatcgtgggagccacgaaccgtaaagacggttttatcgagggaaacggctacgccgtaacctgggccttcggccacctggtcgggctggcaatgccccaacagtatggcatcgcgggtttccgccgggaaaacctgcctatcctgccatcatcgttcatcctcctgccccggcaggttcgggagggtaaagagtataaggccgacccgggtgtcgtgaagcagctcggtattctccgggaattgttcggcatggccgagcgcatcatcgtcgcgaccgacgcggggcgtgaaggggagctgatcttccgctacatctactcttacctggaatgccgcacccctttcgtgcggttatggatcagcagcctgaccgaccgggccattcgcgaggggttacaacacctccgccccggcaacgaatacgacaacctctacctctcggccaaagcccgcagcgaagccgactggatcgtcggtatcaacgcctcgcaagcgcttgccgtggctgccgggcggggtgtctggtcgctcggacgggtgcagacccccacgctggcgatcatctgctcccgttacctggagaacaaggcgttcaagcccgccgcctatttccggctgaagctctccacggcaaaggagggcacggagttcaccgtcctctccacggagaaattcgacggcagggagaaggcggaagcagcccgcgccgaggttatcggcgcccgaacggtacgcgtcgtgaacgtggagcgcaaggaggccagggaacagccgcctctcttgtacgacctgacgacactccagaaagaggccaacagtcggtatggtttttcggcagaaaaaacgctcgacatcgcccagtcgctttacgagaagaagttcatcacttatccccgtaccggctcacgctatatatcggaagatgtggccgaggagattccggcactcatcgggaacatgacacgctatccccgtttcgcggaatacgcgggcaggatggataccgcatctctctcccgccgaagcgtggacaacgaaaagatcgccgaccaccacgcgctgcttcccaccgagaacctcccttccgaactggatgccgaccaccgcatcgtctatgagatggtcgcggggcggatgctcgaaaccttttccggggcctgcgtgaaagaaaacacttcccttaccctgcaaagcgcgggacatgatttcacggcccgcggcagtatcatggtcgagacgggctggcgggccgtcctgaatgaacctgtcgaggagaaagaggaggacatgaccctccttcccgacatcgtgcaaggcgacgagctgcccgtcaaaggatgcgtcacggaacagaaacagacccggccgcgcccccttcacacggaatcgagcctgctggcggcgatggaaaccgccggacgcgaactgtccgacgaggccgaacgcgaggcgatgaaggatgccggcatcggcacgcccgccacccgtgccgccatcatcgaaacgctctttgcccgcgagtatgtcaggcgagagaaaaagtcgcttgtacccacggacaagggactggccgtgtatgccgtggtcagggacaagaagatcgccgatgtcgccatgacgggcggctgggaactggccctctcgaagatcgctaccggggagatggacgccccgacgttccatcgcggtatcgaggtcttcgcctcgcaaatcgccaaagaactgctggaagcaagaatcgacggcgcggagagtgacacagcctgcccgcgttgcggcaggcccgtggtgttctatcccaaactcgccaagtgccagaatcccgattgcggcctgaccgtatggagaaccgtggcccgcaaggagctgaccgacaagcagctcgcggaactgctgaccaaaggcaaaaccggcacgatccggggattcgtcaaaaacggcggcgggacgttcgacgcggccctcacgctcgatgaccagttcaagacctcgttcgttttcgagccgcgcgatactcccaggcagggaaagaggaacaaacggaaataatcgttacctttgccactggaaaagacctgtcataacgagatacgcttgtttgataaggattttttcagtggtcggcgcttcgggtgggaacccggggcgcctttctcttccccgattatcaacgaccactaaaaattcttatcatgccagacaagcaacaccatacccccacgggggaattgtcctattacggactttcgttactatcctacctcaaggacagccacccggaactcatcgccgaaggtgagttcatcgccgagcgggccgacagcgccgcccaagcgtacagcgaggcgatccgttcgggctgcaaccacatcgaggccgaagaaattgcccgcgaggaactctgccgcggactgcacttttcaccctacaacacgctggtaaacatcctctggagggaattcgaggcggagattcccgaggataccgcccggcaggcggctctacgcctgctgcccctctgccgcggggtgctggagaagtacgacctcacggacgacttcgctgacacgcccgactacgaactgttctataccgaactgacgggaaccgtccaaatacttctcgaagatggcattcaataagaaaacccacctccgccagaatatcgacgcgctgaagacggccttcacgctcgacagggaacggcgggcgccgactcccgaagaagaaaggacactcggcgcatacagcggcttcggcgccatcaaggaagtgctggaaaaccccaccgggaaaccggacaaggacggcatggcaacgctcgtggccgagttgcacgaggtcatcagggcgaatactcccgacgaacgggaatacaagcgctacatggacgggatcaagaactccgtcctgacggctttttacacgcccccgaaagtggcagacgccatcgtggaggcgatatgggacacacggattgccccccaacgtattcttgaccccagtgcgggaacgggggttttcgtcaatgccgtggatttccacgacccctacgcggagatcacctgcttcgagaaagaccccgccacggggttgatcctgaagcacctgcaccccgaaaaacgggtgcggatacagggattcgaacgtatcgaacccaaatacgccggttactacgacgtggccgtgagcaacatccctttcggggacgtggcgctcttcgacccgttcttctccacccataccgaccccgtgcggcggcaaggcacacgggcgctgcacaactattttttcatgaagtccgtcgatatggtacgcgagggcggcctagtggcattcatcacctcgcagggagtattgaacgccgagcagggacgccccgtgcgcgagtggctgatgaaccgctgcgagcccgtatcggccatccggctgccgaacaacctctttacagaacacgcggggacggaggtcggcagcgacctggttatcctgcaaaagaaagccgccacgggggaactgtccgaacggcagcgggatttcatcgaatcccgcaagctgtcgaacggcatccggataaacaaccttttccagtcgttcgacagggtgatccataccgaggccaaagtaggcaaagacccctacggcaaaccggcgatggagttcacccacgcggagggcgtggacggcatcgaccgggagatgcggcgtatgctctcggaggatttcaaccggcatttcaacgagagttattgcctggaacatgctccggaacagacacccggtacaccggagcgggaattgtcccgtccccgtcaggcggaacgccagcgtgccgaaagacacgagccccgccttgccggagaaatcgtcaaggagattatcgccgacgcccgtaaccttcagcagcaacgggaagaggaggaaaaacgccgcgtcgtcgccgaaatggcggcgcagggctaccatgtcgataccgaaaccggggagattacccgaatcgaaaacaaacccggacaagcgttaccggattctgccgccacatccgccggagaaccgaccggggaggatctggccgacttcggggcctggtcgaaggagcgggagaatcgcttgtgggagcaacacccgccgaaacccgaagatttcggcatggcggatactcccgtgcagcacgtgggcggaacaacggaaccgaaaccgcgggagggcttcgccgggtcgcttttcgacacggtggaaacggcggctcccgcacctgccacccaagctgccgaaccggtaaacgtgcagcaggaaccgttgctgacgctctacgacctgttcggcttcagcgccgaggagcggcggcaggcagaactcggtatatccaagaaaaggaacagccgccggggagcaaagcggaagacgccccggcaaccctcattattcgccccagcctcctctccggaggaacagaagagcgaaatgccgaaaacgacgccaccggagcgtgatcccgaagacttgtatgcctccctgaactgggaggacaacccgccgatcaacggcttttacgagatgatgatgtcgcttaccccggaacggagggcggaactgcgccgacaaagcacccggcagcaggaaaccccggaacagcgggaacggcaggcggtacgccccccgacggaagccccgaaagacagacgggaacaagccgccggtacgccgagaacgggcagcttgttcgacacgccggacaatccggaggaggaagaacccggtaaagaaacgccgcagatacgggaggcggatatgaaaccccgcccgttcgagggggaggtcgccccctatttccgcgaagggacactcgtcacggacggacaaaaccgggtcggctacctgcgggggattgaatccctgcaacccatgttccacccgctggaactcacgcctgcacaacggacgaaagcctccatgtatatcgagatacgcgatgcctattaccacctttataacaacgaggcggaaacactgacggcgaaccccgccctgcgggagatgctcaaccggctttacgacaatttcaccgaacgcttcggacggctcaatgacaaacgcaacctcgacctgatcaagatggacgcgcggggaacggagattctatcgctggagcgttacatcgacggcaaggcacgcaaagccgacatcttcgagcgtcccgtggccttcaatcccgatgagatcacgcacgccgacgacgcttcggaggcccttgtggccagcctgaacaagtacggccgggtggaaccgcactacatggcctcgctcacgggaactaccgtggagggaatactcggggaactgaaaggacgtatctattacaacccggaaacggacggctacgaggttgccgacaagttcatcgccggcaatgtcatcgggaaagccgaacggatcgaggcgttcctgcgggagaatcccgaccacgccccggcccgggaatcgctggaggctctgcgcgaggcgacgcccaaacccatcgctttcgacgacctggacttcaacctgggcgaacggtggattccaaaaggtgtttacgagcgtttcgcctcctcgctcttcgatacggaggtgaagatcaccttcgcctccaacctggacgagtacggcgtgaaggcggaagcgacgaacgtgaagatcacggagcagtatgccgtcagcgcgcagacccgtaagtacaacggcctgcaccttttgaaacacgccctgcaaaacacttcgcccgacatcaccaagaccgtcctcaaatgggtggacggcgaacggcgggaggtcaaagtgcgtgacggggaggccatacagctcgccaacagcaagatagacgagatccggggtgctttccccgaatggctgcgcgagcagtcgtccgacttcaaagaccgcctgacagacctctataaccgtactttcaactgttacgtgcgcccgaagtacgacgggacgcaccaggaattccccgacctcgacctcaaggggctgggaatagacaatctgtatgacagccagaaggacgcgatatggatggacaaactgctcggcggcgggataatcgaccacgaggtgggcggcggaaagaccctcatcatgtgctgcggggcctacgagaagaaacgcctcgggctggccaataaacccatgattatcgggctgaaagccaacatccatgaaatagcccggacgttctgtaccgcttacccgatggccaaagtcctctacccgggcaaggaggatttcacgccccggaagcgtgagcgcatcttccgggagatacgcaacaacgactgggacgccgtgatcctctcgcacgaacagttcggcatgataccccagtctccggagatacagcaggagatattgcaggccgagctggactgtgtggaggagaacctcgaagtgctcaaagcacaaggcagggacgtttcccgcgccatgatgaaagggtgtcagaaacgcaaggccaacctggaagccaagttgcagaaggtggcgcacgcgctggaaacacgcaaggacgacgccgtggacttccgcctcatgggtatcgaccacctctacgtggacgagagccataaattcaagaacctgactttcacgacccggcatgaccgggtggcgggcctcggaaatcccgaggggtcgcagcgggcgctcaacatgcttttcgcgctgcgtaccatacagcagcgcacgggccgcgacctgggggcgacgttcctctcgggaacgaccatctccaactcgctcacggaactgtacctgcttttcaagtacctgcgcccgaaggagctggagcgtcagaatatccgcaccttcgatgcctgggcggccatatttgccaagaaaaccatcgactacgagttttccgtgaccaacgaggtcgtgcagaaagaacggttccgatatttcatcaaggttcccgaactggccatgttctactccgagattacagattaccgctcggcggaggatatagggatcgaccgaccgcaaaagaacgagatattgcacaatatcccgccgacaccccagcagacggagttcatagaacgactggtgcagttcgccaaatcgggcgatgccacgctcctgggccgcctgccgctctcggagcgggaggaaaaggcgaaaatgctcattgccacagactacgcccgcaagatgtcgctcgatatgcgtatgatagaccccgaactatacagcgaccacgtggacaacaaggcgagccactgcgcccgtatgattgccggttactaccgccgtttcgaggcgtacaaaggtacgcagttcgtattctccgacctgggaacctacaaacccggagcggggtggaacgtctattccgagatacggcgtaaactcgcggaggattacggcataccccaaagcgaggtgcggttcatccaggaggcgacctcggaaaaagcgcgcaaggagatgatcgccggtatgaacaccggaaaaatccgcgtactcttcggatcgaccgagatgctcgggacgggagtgaacgcgcagaaacgctgcgtggcgatacaccacctggactgcccctggcgtcccagcgacctggagcagcgcgacgggcggggaatacgcaccgggaacgagatcgccaaactccatgccgacaacaaggtggacgtgatattatacgccgtcgagaagtcgctcgacgcctacaagttcgggctgttgcacaacaagcaactgttcatccgccagctcaagaccaacaacatgggaagccgtaccatcgacgagggggccatcgacgaaaagagcggcatgaatttttccgagtatgtcgccgtcctctcgggaaatacagacctgctggacaaagcccgcctggagaagaagattgccacgctcgaaagcgaacgccaggcattcgtgcgcggcaaatcatcgagccgctacaagctggagcagatcacggagaagatagagaagaacaacgacctgatacggcgtatcggcaaggatctggaacacttcaaggcccgcgtcgagttcaacgaggacggctcgtaccgcaatcccgtgaaactgaacgggctggaaacctccgaccccaagctcatcgggaaacagctcaaccatatcgccgaaacggcacgcacgctcgacaggctcgaacccatcgggagcctctacgggttcgagctgctcgtccagagcgaaacgaccgggaaagacgggctcgacctggtgcagaaccgtttttatgtccggggtgaaggggattatctataccagtataactacgggaatatcgcctccgacccgcgactggcggcgatgaacttcatccacgcgctcgcgaccatcgagccgacactggagaaattccggaaaaagaatgaggaactggagaaagatattcccgtcctgcgggaagtggtggaaagttcctggcgcaaggagcccgaactgacggccctaaaagctgacctgacggaaatagaccgcaggatacagcaaagcctcaaaccgatagaagagagcgagggaaaggaggcggaggaggataacgacgtgtgccgggaacggcatgacacggcggaagagctcccgaaggaagacaacacggcggcccgtattccttcccggctgcggcagattgccgacgcctccggggggcgcatcgtgatcgcgggcgtgggcagcccgccggagaacggccctgcgaagaaagggatcaagatgtaaacgaaaagccgacggaagtacagatttccatcggcttttttcatatgtccgtgagcgttgtcgtcacacttcctgcaagagtgtttgcagctcctcctgcgtgggaagataggtcatgtactgggcggcgaagacctgcttttcatcttcgggcagcgtataacggacgaccgcgtcgtttttctccgcgcagaggacgatacccaccggagggttatccccgggattcatcaactcacgggtgtagtaattgacatacatctgcatctgccccaaatcctgatgggtcagctccccggatttaaggtctattaaaacgaaacaacgggccaggtaattgtaaaagaccaggtcgatgtagaaatgcttgtcatcgaaggagatacgcttctgtcgcgcgacgaaggcgaagcctttcccgagttcgagcatcaagcgctgcaagcggctgatgagcagttgctccagatcggtttccagaaaatgctctccctgcgggataccgagaaactccaggatatacgggtcgcggatgatctctttgggttcgacacgtccgggttcggtacgggaaatctcctctttcacagctttcttgtctcggctggccagcaggcggtcatagaaaagcgtgttgatttggcggtcgagctgccggacactccagttttccttgacgcactcgtgcaggtaaaaatcacgggcggcatcgcccgacaccttgagaagcgtgcggcaatgcgaccagctcaatttatcacacagcgtgtgatatttcgggtagcactggtaaaactgcctcatgtaccgcaggttggtggccgtgaacccgtttccgaactccgccacgagccgcctggaaagggtgttgatgacagccttgccatatccggcacggtcggttccctgctgctcgtactccactatgtatttccctacctgccagtaagccctcacgagggtcgaattgacatgatgtatcaccttcgcgcgcgcttcctgcaagatatggcgcacattatgcagcagctcttcctcccctttgtcggcaggatatattttatcagtttctttcattgcttcattattatataggcttcattcagcaaacatactgattttacggcaaatatcgagcggttgtaccgccttgtcgtgccttattccatgtatctccgcgtttttccatgacgccggactctcgggacagggcctaaccggaaccggcaggacgatcctttttcagcttgcggaaattactgaagttacgctcgatgaaccgcaggacgtccgattcccggtagaaggtcttgtgatagatcatctcgtaaggcagctctcccgaggtgcggtaacgctggagtgtgcgcttgctgatattgagcatacggcacaggtcgtaattgtccagaagacgctccccgtcaggcaggatggaaagcggttgctccacgtcccccgcgcacagcttctcgatacgttccagccgttccgagagccgctgcatccatccgtcgaaatattccttgtccagaaacatggcctactcctttggttggttcttgcgccgcacggaacgctccttcagcacacggcggatttccgtgagggaataatacagcttccggttgatggccgaataggtgatcacgtgatccgagcggaggcgttgaagggtacgcccgctgatacccaggtaacggcagacctgctcgccgtccatccattcgtcgtttatatactccttattccatgcacgccccttttcagggagagaggcgattgcagcctctattttctctatacgcccgacaagctcgttataggctcgcgaaccgatcactatgattttcatactcctttgttttttagtctgttacaaaggtcgggcttatatggacagcttaaaacgaggtcggtacgacttttttttgataatttgcagtgaactgattctcaacggttcatgcggtgaagaaggcagtgttttttaccgaaatccgcggcccgtactcggtatttttatgggcagaaatgcgatagaatactgtgattcaacgcttaacggtgttctaatccggacggggctacaacggaacacccgtatcggctccttatacgggtgcaaatacgggcgttcgggaaagttcctttcgagagttacgggggaaaaccgacctcggttcttttgttatatacaacgctgattatcagtgtttctataaggaatagagtgctttaccggttcatattctactcggaattgccgtttttcttgtttcgcttccacgtctgcatacgtttaagcagggcctctttcgccttgtcaagccacggtgtcgggttgtttcggattttcatatcgcagaatgtcctcgaaaggttcatgtcgaggtgtacgttgaaagcgttggaaatgtagctggcaagttgcgtgagtggcacattgccgaaacagcctttactgtcgagcaggtaaataagttccgtcagatccgtcttcgagtcctgccatgtcggacgcacgtcagacaatggcagaaccatgttccggaggttcgtgctctccagtgattccaattcgcccataagataaaccgacaacatatcgttggccaggattttcgccaccttgaaatccgcgtttgtcgaaaactgcgggtcgagttcatagtagaaggtttccaggtattgctccgtgtcggtctgcccgcgcaggaaatagaggctgtccaggtgtgtagcgccgctgcggaaatagcggataaagtcaaggcgtttctgcgtgtacgcgttgatggcccgaacatgggcgtccaggtactcccgttgtgcctcgatacttcctaccggacggttcatctcgatattgtagagcttgcggtaatagatcagacggcaaaaaagacgaggtttgatttctttgaagaactttatttcctcgtcatcgttttgaaaacggtagccgatgatatattgtttcaaacggtcgaacgcttctcccaggacacgtgacgcttcaagcgactttttcaacacgtcggtatcccgcgattcgatacgttcgatactccgcaggacttcgctgtttaatttttctataaatgcaatcataatccgtcttgttactttcgcgtataaagttagcgaatcgaaaaaccggcggattacgatttttatctttctcttcgtttttttatcacggagccgattttaatgtcagatccggctttcctgacggatggaagtgggattgctccccatattccgcttgcaaaagtccgtaaagtgggattgggcggagaaaccgcacatgtaggctatttcctgcaacgtgtagtgtgtcgtccgcagcaactccccgatacgttcgatacggcgctgacgcaaccacgaggaggccgagcagccgaaaacccgctggaaacgccggcggaaggtaatcgtgctggaatacccgcaaaccccagcgagttccgtgacgttatccgaggcaagataattcgatttgacacgggagatgaactcgtaatcgtcccccaggtgcaacagctcctcgaactccccgacatcggcgggagtgagatgttcataagaggcgtcgagcattttcagcatgacagcagcgttacattcaacgggcatacccaatgtcttacgggcttcacgcaggtaattcttgaaccgcagccgcagcgtgtcgtgatgcgggtaggaacactgggacagaatggtgcagaccgtccgcagttcatcgacacaacagtagccgaaataccacgttacaagacgctcgacgtaatggacggcatgaaactcctccgaaagcatcagaagaagcaggaacggggtgaaatcctggtattcccccgttatgggacggggtgcttcgtcaagcaaggaggcaatgtcccgcatcagaagagaatctcccgagtacgcttttatttgttcggaactgcgggcataatcccggtaacgcgatatgaccgccgacaaagcattgaacttcacggcgtgaacgccttctataaaggaagggcgaagactgttgtaaatggataagtcggtttgcataagtcatttctatagaacggagccgcatccccttgttgccaaagctccgcaagtcgttacttatgaaccgcttggaacacggtacgaatcctaattacaaatatatcgtatccgacaatccggaacaaatatcagcaggcaaaaatgaaaataaacctcgttatttttgattattacctgcaataatattatatttgcaaacaaataagagttgtttgacagcatgagaaatatagtgtatcaaagcactttaccaatttcttatccgttgcccattctcatgcgagtttcttttaatctatttgtagtcaattaaataccttcagactacatcaaatatacaaaaaaatgtaaatacagtatgagtatccttgaaatctagttaaattctacttgaggacaaagaatgtcctcactaattatccgcttcgcaaatgatatattgataaaggtcggaatgtccggttttatcgattatcttatgcttttcgagttggaatttcagttgggccaaaccaagagcaccaaagccgggaaggtctaataaagaatcgagtccgtttttgagggcgtaacgtagaatatcttctatggtttctatattcaaggttgtaaggcatttacggatatagggcgctaaggtgagacgggtaatgggttggcatatccgtttcgcggcatttaagggaacgggagtaagtgatcggggagattcgatacatagaccgttttggagcgcctttttatataatcttctcaattcgtattccatgttcctgttctctatccacagacgttctatctcaaggtcttgattcgtgattgttttcttgtattcggtcaggaagcccatgttttcttgcaagcggagcgatatgaccttatatcggcgacagattccgtcgtaggatataccacaacgtttggctacgtcttctatcttggctccggaagttatttccgtaaagataagtcggtctttcttgtcgtgtatgaatgttgatagttcggcgataatgagtttaagtaggggagagatgtttttaagggatcgcaggcagaaaaggtaatcatcgaattgggagatgatctcgtttatctcttcttccttgtcttggatgataagttgcaggtatagcttttgtattcccatacgctcgatatgggaaataaattcacgtaaattggtcagatcgactaggcgaacaccttgcttcacgacgtaagatgttatttttttagatatcgcccattgctggatttcttcagatggaaagccggtgatacaagcggcttcttcaatagtaataaactcaggcataactatttgattaaagtaaaacttatactatttatctttaaaaagggcgttatttggcgttatattgaagagctggcctttcattataaaataaagaaagggcgattggctgaacattacgttgacaaaggttccgctaaaaacccacattagagtaaagtcagccgcacgcccccctttatctatatacaataatcttatccatactttaacagcatagataacacgtatattcggtaaagggttgcggggccttctttgcgcttctctaaagttgaaaaatttagcggattctgtcaactcgcacaaatatcgcacgcaacacaaggcttctaacttaaaagccttttattgtcgcaaatatacgtatttaaaaatattttagtctataataatccatacgttttctattttatcattgttttactaccaacaaagaaagaataagtagataaaaacctatgcttttaccttttgcttttctgtcttaattactagctaggcaaatatatgatatattctttaattataattgattattaaggaagaaatcaagatggcaatccatcaaacagtacgaagactactaccctaaagtttatggaatgaccttacaaaacacttttatagtgcaaaaaagattaggtacattgccaaatggcttttttaggtagaaagttaccagttaactaacatttcaaagtaagttagcttcaacggcaaagtaagctaacttaaatgaccaagtaagttaacttcataaatccggggtgaaatccgcaaacgacatacaacacgcatctacactcccaacactatataaccgctatggatatttgaagtattgataataggcggtttacttctgttatccgtaactccaaccttatcagtcaacaagcctttcattaaaagataagcacatcataatggcacgactgtgccatcctagtggcacaccattgccataaggaaggcacagctatgccacgccaatggcactgccgtgccacgatatgggaaatgattggcactgcggaagtctgttaactagacagttaaggatggataaataattattcccctaacttatcaagcaactcatacgacggaacgaagaaaagagttcccgttatcggcgtgctgaagtccagcagacgatccgtattgcctacgggatcaccgacgaacatattctccagcattcgtcgggtggtgctgaacgtgctggcataggcgataaaataggtaccgtattcacctttggaggtatgggcgaatggcatgttagcacggactattttcagatcgtctccgatgttcgtcacggcgttatgggcgttcttcggtttttcctcatctgatagctcgacatcgttgaatttacgtcgaccgatgactttctcttgctcttccactggaagcgcattccatgccaccatatcatgaatgtatttttgcacaaatacataacttccgcccataaactcggggtcctcatcgcctattactgcgaaacgataggggtcttcatccacggcagggttctccgtaccgtccacgaaaccgataatcgccttaccgtctctataccgaaaaccgtgggtctcatcgatcgattccacgacaccccgcagtttctggtctataatggaggcgaactcaaagcacagtcccatctgcttacagcggatgtggaacagtaaatccccgggggtagaaacagccgtaagcttaactcctttgatctcttcaaacggttgcaattctttggggtttccttgctccgggaagaagcgtttccaagcatccgccccgaatcctatcgtacaactgaattgcatatcaggatagcgattgcgcatactacgtatcaaagcggagaaattagcgcacacgtccttcaccttatcaatcgtgtcggggagatcttttagagcatagacaatgaaaaccgcattctcacccggtttttgggtaacatcttgcggatagttagcgttcaatggattttgtagagagttcatagcacatctttaattatattgttattatatggatataactctatagatgctctcttgttcaaggaaatgtaacgaaaaatgtcctagcggttatttttcaatatctagttgtagagacggggcgtaccccgtctctacaactgggtagttatttcacctccacgctgatcttctgcttgatatctgaggcggaggctcctagttggaggatgaactcgccgggttctacgacgaattggctttgtgcctcactatagaaagctaaagaggatacggggatgtccaacgtgattcgccgactctcgccgggtttaaggaataccttcttgaagccctttaactccttgaccggacgcatcacggagcaaaccggatcgcttacatacaattgggccacctcagctccttcacggtctccggtattggttagggtgaaagtcgcttggatcgtatccgcttgatcgtacgtctctttatccgtattcaggttggaatagtcgaatgtcgtataggataagccgtaaccgaacggataaacgaccggaagccccttcgtatcgaaccagcggtaacctaccaagatatcttcctcataattcactttcaaatccctgccggggaagttgcccaacgcatgcgccggagattgatccaagctcacgggagtggtgaacggcatcttcccgctcggattcaccttgccggataatacgtccaccaaggcatttcctccttccatgccgttgaaccaagcccaaacgatagccggggaacaaatatccacggcggccatattcagcggcgatccggcgatcatgaccacgatcgtacgaggattcgcctttaccacctcttgaatcaactcaacctgtccgtaagggatatccatattcagacggtcgaacgactcggtatcataatcatggttcaaaccacaaaccaaaagggccacgtcactcgtgcgggcaacctctaccgcctctttcaataacgcgtcgctttcctgtgtcttggaagagaaagtaccagagctttgcccattattgcttccctccacgaaagtagataacttctcatagccttgggcaaaacggatatccaccttatcgccccatttcgcacgaagcgcccctaatggagttacctcgtaaaccgccttgatctcggaactcaagccaccattggaatgtttgcgggtagcgttatcgccaattaccgccagactcttgatcgaggagaaatccaacgggagaagattattctggttcttcaataagacaatggcttcggcagccgcgtcgtaagtggcttgctgatgctctttcgtattcatggagcccgggccgaaacgctttttcgggtccaagacattcgtcttgatcatcacacgtaagacatcgcccaccttctcgtccaccaagctcataggaaccttaccggacttaacagcatcgatcaaggggttggcataataccaatcctcatatttatcaatcagcgtgcccatctccagatccaagccggcctccatagaaggaaccgtgctatgagcggctccccaatcagttacatatacgccatcgaatccccattcattccgaaggatcttgcgaaccaagtagttattctccgcgcagaactccccacggaatttattataagcggccattaccgtcaaggcgcctccctcctgtacggccgccttgaaagcgggtaaataaatctcacgcaaggcacgctcgctacattccacatcgaccgtcgtacggtttgtctcttggttattcacggcgaaatgctttacgctacaagccacgtcacggctctgcaagcctttgatataagcgaccgccaatacggagttcatataagggtcctcgctcatatactcgaagttacggccacaaagcggggagcgaatgatattcacgcccgggcccagcaacacatccttctttcgccagcgagcctcctcgcccagcacctcgccccggcgataagccaactccgggttccaagcggcggcgaaagccgtgccggtcgggaaataagaggcggaatcatttgtccaacccgcatacgcccaatcgtggcgattgatctccgcacgtaccccgtgaggcccgtcgctcaagctccactcgggaatccccagacgctctactccggcaacatagaattttgagttaccatgcaacaacccgaccttttcctccaaggtcatcttcttaatcagtttctcgatacgtttctccatttgtaccttctctttatccgtgacctgcgagctcgcggcagccgcgttcaagaatagcccgcaagcgatcacgcctattatctttttcatttcctctttatttataggtttattattgcgcttgaatcgttaccgtcgcctcgggtaagccctcggctatggcttttaagtggatgtcgccttgtccgcccttgttccggatcacgaccaaggcttttccgtagtaggcttgccgtttcggtttacggaggctgttcggatcgttcggatctccgttatccgttccggcgatctcacccgggccctccacggagaaacggatcaacggggtagcgtcgggaacccggttaccatcgatatcgcatacatctacggttacaaacgataggtccgagccatccgcttggatgacgctacgatccggggtcaagaccaaacgggccggctctcctgccgtatggatctctttcaccaagacctccttaccccctaagcgggagacggctctcaaggttccgggcgtaaaaggcacacgccaagagacatgataggtactgtccgttttttgtcgtacgcctaggctctttccgtttaggtatagttccacctcatcggcattgttataataggcccagatatccacccgttcgccttccttccagttccaatgcgggaaaatgtgcaatacgggttcatccgtccactcgcttttatacatataatatacatccttcgggaaacccgccagatccacgataccgaagaagctgctccggctgggccaccaatagggggtaggctctcccaagtaatcgaaacccgtccagacgaacaggccggatacatgcggaagcgtcttcaccagatgccaagtcttctcgtgcgtagagccccaaggtacatggcaattatcataagaggagcaaacatgctcgggagcctcgaaaggcttgtcccacgattccggacggatataaatatgatcggacggcatctcataatagccacgggtcatcaaggccgaggtagattcgctcacgatcagtttccttccggggaaattccggagaaacggttcaagatattgctcatggtagttgaagcccagcacgtccaaggcatccgagcggaacagatgattcgcagggtttacctcgttacagccggcggtaacgacccgggaagtatccagccgtttcacgatagccgccagatgacgggtgatcaaggattgacgactaagggtcgtatccttcagcaaagcgggatcaatggcatggcccgcattcaagatcaggttcgccgcttgcagatccagctcggtagcgtcggcatgactccattgctcaagtacctcattgcctatactccacatgaaaacagaggcgtgattccggtcacgcaagatctcgtccgtcaaatcccgctcatgccactccgcgaaataccgggcgtaatcgtatggggacttacggcgttcccacatatcgaaagactcatcctgtaccagaaggcccatacgatcgcaaagatccagcaactcgggtgccggggcgttatggctggtacggatcgcgttcacacccatctccttcatgatctgtagctggcgctcgatagcccgtgtattcacggcggcacccagacagcctaaatcatgatgcaggcaaaccccttttatcttcaaaggcttatcattcaaataaaagccggtagcggaatcccaacggaacgtacgcaatccgaataccgtctcgtaacgatctaccaccttaccagccactttcacttccgtgacggccgtgtagagcgagggagaatcggggctccaaagcttgggatttgagatcgagaactgatgatcgacagatgcctcccgcatacgggtgtcgtaacagggcgtatacggtacccgtaacagagttgttacgggtgccgtaacaactctgttacggtcatcgtaaatagaggtagagacttcggcctccctatccgcctccgagctattccttattctcgcctccaaggagaaggtagcctcctccggtgagatcttcatatcatgcacgaaagtgccccagttgtccacatgtaccggattcaccttcaccagccatacgttacggtagataccggagccggaataccagcgggagttcggctgctcgctattatccgccttcactacaattacgttcggttggcttccatacctcaaataaggcgtcaagtcataacgaaacgatacataaccattcgggcggaatcccagcgaatgaccattgatccaaacctcgctattccggtaaaccccgtcgaaatcaacataaacaaccttaccccgatccgtctccggaagggtaaatgtctttcgataccagccaatcccgcccggtagcgcaccgccgcccggggtagacgggttatcgagggagaaatccccctcgatactccaatcatgcggtaaagataagatacgccaagtggaatcatcgctgtccggggatgaataatcctgaacgctatccgacaaggcaaatttccaatcgtcattccatgagctacgttcacgcacctgctccccggtgggggaacaggcggtgagcaataggcccagaagccacgcgaatggccgattcatcagtgatatcattagtgattatatagtttaattgatattacccagttgtagagacggggcgtgccctgtctctacaactagaggtttaccttggtaagatattgtcacgtccttgccagcggggttctccggcgtgatgagacgtaccgtgatctgacgctcgcggatcatgcccggataatcgccctcccgcgcgccgatcgtgagcgttcgcctcgcatcatcataaacaaacgggatggtagcgtaatttcctttctcgtaatcgtaggtcacgccattatcctcatataaggtgaaggagccgtcggcaccggcgtaaacagagacggttaagtctttctgctcctctttcgtagactggattacctttccggtcggtacgatagaaccggctctcacgaacaaaggcatacgctcgtaaggagcatccacgtccattgtcgttccgccttgcacaggcttgccgttgtaaaaatcgtaccaaatgccggccgggaagtacacctcacggtcgcgagccttatactcatacaccgggcatgccatgaaggccgggccaaacataaactggtcgtctatatcgtaagtcttctcatcgtccgaataatccatcaccatggcacgcatgatcgtataatcctcaaaatgcgtcttggaggccaagctatagatatacggcatcaattgataacgcaactcggtataatacttcatcgattggtacgtaggcgatccttccggagcgatattatagatctcgcggcaaggatattgcccgtggctacggaacaacggacagaaagctccgaactgataccaacggttgttcaactccctccattccctcaaatcctcgctaccttccttagcagccatataacggttctccacgctgaagccaccgatatccatcgtccagtaagggataccggacatggcgaagttcaagccggcgctgatctgcgctttcatatcctcccagcgagtaccgatatcaccactccatgtagcggtagagtaacgttgctggccggcgaaaccggaacgggtcaacaagaatacacggtcatccgggtttacgctacgttgtccgtcgtagatcgcctcggcgttctccaaggcatacgcgttgaagtatttcgtggacgggcccagataagtcggtccgcaaagcgccttccggtattcgatgtccgtattatcctgtacgttcggctcggaagcgtccatccaccaagcgtcaatgcccaaggaatacagatgctcgttcatctgttcccagaaaagcttgcgggcttccgggttgtacgcatcatagaaagaaccgatataacccggataaatccagtcgcggatactatccttaatcgcctgctgatacatggcacccagcgcgtccaactctttataatgctctgtcgtataataaaacttcggccatacggagatcatgatacgggcatccttatcgtggatttcccgaatcatgcctttcgggtccgggaagcgttccttatcaaactcatggctgccccacgcatctaccggccaatagctccagtcctgtacgatcacatccaaggggacctgccgccggcggtactcgtccaaggcacccagtagctcctcttgcgtcttataacgctcgcggctcaaccagaatcccatcgcccatttcggcatgatctggctcttgcccgtaaccgtacggtaaccgctgatcaccttatccatggaagactctccattgatgaagtagtaatcgatatcatcccccatttccgaccagaaagccaaccgctcccgctcctcctccggtaacggagataataccttcaagccgatataagagacatcgccatccggcaaccattcgatacggatcggataacgtttgcccttttccagatgagccgtggctttataatcattcgggttccaagccgcacgccagcgttccgggatgatctccttattatccacaaagaccttggtataaccggcgtaatgcagtttgaaatggtacgtaccggtctcctttgcctcgatctcgccctcccaagtagcggaagcgctcggcttcgggaagtctgccggcaggttcttgatggttttcagattctcataatccaccttatcctcatcccgtcggattaaaacggaatgcttcgtcttatccgtatagtaagtagcggtcaacgcccctgccttcccgtctttcccgtataggccaaagacatcgcccaaatcggcgtatggacgcttgtcgccgaaacgactcaaggaatagttatgccaaagtacaccatacccttttgaggaaacgataaacggcacgctcaccttcgtgttatattggaaaagctcctcgttcttgcctttgtagttgaactcatcgctctgatgctgtcctaggccgtaaagcccttcctcgtcctcgctctcaaatacctgacataaggtatagcctttggttccttccacctcgatcggcgtaaactccttgccgccgtttgccttctcccgaaggatcgtgcgtccgttggcgtcggtaaaacgaacctctccggtctcccgggaaagacgggcctgtgtggtttgcgtacttacgatgatcgtatcccccgaggtcgttatctgaaacgatggggcgggcaacgatttcgtgtctttgatcaagttcacttggttggaaaacttaccatccggagaggcgattacccggataatatcatcagagattacttccaatttgacagccttcgcctgtccggaacggatatcggcgaccaagccattctcgaccttccggtaagcggaatcagtcatgcaggaagtcagcagggaaagccctaacgtgaataccgcgatgtgttgtttcatattctatagattctttaattatttccgatcagcaatgacttcgaacaggtttttccatacaagaaaaatggttcttcattcgttggcaaaattaaagggttcgcggcggacaggaagccataaatgttttgggttacggggagaaccgtaaaaaggtaggggaagaatgtttattttaaggggatattttgttatatcccctaattacgtggcatttatttagaaaaagtttatttatgatagtcagagggaagccttccgaactcatccttaaaatacttccggaatagcttcacatcattgaaaccgcactccagcgcaacctcgttgacccgcatctggctcttctccaataactgtgccgcacgcttcaagcgcaccgtacggatcaactccaccggagtcttacccgtgatggaaaggcatttcttgtagaagttcacacgactcatgcccatctcccggctcaaccgttctacagacaactccggattggcgatctgctcctcgatatagccgatggccttacgcatcaactcctcatccatggagctagcttgtacttccgtcaaggcgatgcccatggtagaggactgcataaaggccttttgcatcttcttcttcatctcgatcaaatgccgcaccttcaagagaagcatctccatattgaatggcttgctgatataatcatccgcaccggcttccagaccgaccagttggctatcttttgcggacttagccgtcaacaggatcaccgggatgtgggaagtccgaatgtctcccttgatccggcggcataaagtaataccgtcggtgataggcatcatcacgtcgctgatcaccatatccggcagctcctccggaatgagtttccacgcatcttctccatccgccgccgtgagtaccgaataaacgccactcaagcttaacttcataaattcccggaaatccgtgttatcgtctacgaccagcaacgtaggtctttccgccggagacgcatccttatcagcgatctccggatgctcctcaaccggaggcaagatatccccttcggcaattccttccggagccgagataatatcttggttgtccaaggggatcaccggcagcgtaaccgtaaacgtactacccgctcccggctcgcttttcacggttatcgtcccatgatgcatccgcacgaattcccggcataggtgcaggccgatacccgtacctaccacgggatttcccttatccggggaagccacctgataaaagcgatcgaagatagctccttgtttatccgcaggaataccgataccgctatccgacacctcgataaccagtttgttctctccctccttctccaaccgcaatctaagcgtcaccgagatagtacctccctccggcgtaaacttaaaagcgttactcagtagattagagacgatcttgaagaccttatccgtgtcaaacttcatcgggagagacgtgaagaccgaggaaaaagagaaatgaatccgcttttgctccgaaagctccttgaaggaataagccacgtcacgcacaaacgggacaatatcgccggtagacaagaccaagctatccccttgcatatcgatcttgcggaaatccaataactggttcaccaatttaagcaaccggtcggcgttccgatagatcaacttcaatatttgctgggattccatgtctttctccgttttcatcaacttctccaaaggagtcatgatcaatgttagcggcgtacggaactcatggcttacgttcgtaaagaaacgaagcttcatctcgtccacctcatgctgctgacgcacagtagcccgttcttgctcctcctccaacttcttttgctggatacggaaaataaaacgtatcacgccatacgccaataatataccagctatgatatacaacgctattgcccatccggtagcccagaacggaggcaggatcgtgatctgcaagctcgtgatctccttgctccaaatccggtcgttattcatcgcctttaccttgaaagtgtaagttcccgggttcaagttcgtataggtaatacgacgttccaaggcgcttacggtagtccattccgagtcgaagccctccatcttaaaagcatatttattcttcaaaggaaggaaatagcaacaagaagagatggtaaaggagaaattacgttccgtataattcagtttcaattgcttggtacaggtgatatctttatccaaaatcacatgcccgtcatacgcctctctcgccgttatcgggacattattcaccataagtccggttatcaccgccggtggagcatagctattataacgtatccgggcaggctcaacgaaggtaagaccgtttgtcccaccaaacgccaactcacccgtttccagcccacaagcgctattcacattaaacacacgtccttgaacgccctcattctcatcatagctattccaatcgaacgtataattattatccgtatcccgattcggaacgatattcaataagccgttcttcgtccccacccaaaccgtatgatatttatcctccaagatagacatgatgctgttatccggtaatccggaagaatggttcaaccgatacatcttatcattcaacctatcatatatatgtagcccatgattactcccgatccatacccattggcggctatcacaaaatacgacattgatgatttgatcctcaaacacggaacgtccatccttcgtgccgttaaaagaagtaacagcccccgtctccgggttgatccagttcactcctaaagaagttccaacgacaatattccccttctcatccccggaaaggctatatacgatatccgagttaatcgcattctccttatcccccatgcgataatacgtccatttcccggtagattgatccaagcaatccaggccgccttccaacgtaccgatccacaaacgattcttggcatcgacatacaaactatacacgctattattggataagccgtccttactgcccgggatatcccgataatgcttgaaacgtttcccgtcaaaaccggtcaacccctccatataagtacccagccataacttgccatccaaatctttcgccatactaatcacgacatcgccggagatagcgttctcgctttcccgtcccgcccggtagcggacatactccccggtttcccgatcgtaacgtaataggccgtttccgctagtaccgatccacagatccccttctttatcttctacgatacaattaaagtcattgttaaagatatcccgcatcaactccaaagggtaccggatagtctggaatttaaaaatgctctcatgataatagttgatgccgtttttataagtgccggcccacataatccccgtatcatcccgatacaagcagatcacgctattctggctcaaactcgtttggttaaacgggttatttcgtatataacgcatccggttcagacgtttatccaagatattgataccgccatgatcggtagcgatccagatattaccgttcatatcctccgccacgtcacgcaccattatagaggataaagcgaccgaggtttcggtcgtataatgtttccactccttgcttttgggatttaggcgaaagagacctctactatatccgggatttaagaaaaaccacagatccccgtcactatcggcgaacacatagaataactgggcattcgcatattgagtcagatactcatcccgatagacagattctccggatgctttatcgatcccctctaccactcccgaggtatggactacatatagacgatcgcccacgtcactcatatcacaaacccggccatcctctttatttagtggatacgaataaatctttcccctcgcttgatcataacgacaaaattcattcgtataggtagcgaaatagagttgtttatcattgtcgacgaatatcttagcgggaggattctctagacgtaagctatctaatatttccttctccggaataaaacggtcattaccgggctcatatacgcaaagttggttcgtattataggtaatccaaatacgcccatcagcggtttcttgaagttcggagacatgctcctccctaaaaggcaacccgctttccttgtatttataatgcttaaactcatacccatcaaaacggtttaccccagaagtggtacccaaccacataaaccccttccggtctttcaggatacaagtgatctcattggaagacagaccgtcctgtactcccagacggttgaaaagaatatcttccgccgcaagtccggatcccaatattccccaagacaggatcattatgatacagagtagagttttcgttttcatacttagcaaatatagatatttcccgaaaacgaaccaaaccaaccggtatctaattctgctgcaatgcgggttgcagtaaacatacacgtaaagtatccatatataagaacatgattattaaaaattatcccgtacatttgtctttcgattggaatagaaatgaataaggcgcaatgattgttgtaagagattttgacagactgaaaggaaaggaactggtggctacgatcggatttttcgatggtgtgcatctaggacaccgtttcttaatcgacgagatgaaagagattgccaaagcacgtaacctgccatcggccgtaatcaccttcccggaacatccccgggccgtattgcatgcggattaccaaccgaagctattaaattcttccgaggaaaagttacagcaattagagactaccggagtagattattgcatcgtattggattttacgatcgagctatcccggctctcggccaaggaattcattacctctattttagcgaagagcctgcatgtaaagaccttattgatcggatatgaccatcgtttcgggcacgatcggacggatggcttcgagcaatatgtcgtttatggcaccgaatgtggtatcgaggtgctgaaggcatctccctatgacgaaggaaatacggccgtcagctcttccgaaatccggaaattacttcaagccggaaatgtagctgaagccgcttatttactgacctatccctatcaattgctgggccatatcgtcagtggctataaagtgggacgcacgctaggatttcccacggcgaatatacgggtagatgaaccttttaaagtcattccgggtattggcgtatatgccgtatgggtggaggtggaaggcgaacgatataagggaatgctttatatcggtgaccgtccgacactcaataatgggaaggacatatccatggaggtcaatattctggatttctccggagatatctacaatgatagcattcgtgtctcattcgttcaatacgtacgcggagacatcaaattcgattccttagaagaattgaaagcccaactggagaaagacagatgcaccgtaaataatttattataatatggaaagatattacgaagcgattgatttattaaaaggcatgatctcccgtccgtctttcagccgggacgagaccgccgtagcggatttcctgcaagcagaatggcaaaaggccggacaaaaggtgttccgcaaaggcaacaacctgtggatcatcgccccggatttcgatttcggtaaaccgacccttttactcaactcccatatagacaccgtcaagcccgcttccggttggaccaaagacccgttcactcccgaagagaccgaggatgatcaattatatggactgggcagtaacgatgccggggcgagcgtagtctccctctatgaagccttctgtatcttaagcgagaaagaacaaccttataatctaatcttccttgcgtcttgtgaggaagaggtatccgggaagaatggcattgaaagcgcattggccgagcttcctcctatctccttcgctgtcgtaggtgaacctacgggtatgcaacccgccgtagccgagaaagggctaatggtactggattgcaccgctatcggaaaggccggacatgccgcacgtaatgagggcatcaatgccatcactttagcgatgaaggatatagaatggttcagcacctatcaattcccggagaaaagcgacttcctcggaccggtgaaaatgactgtcaccatcatccatgccggtacacaacacaatgtcgttcccaataaatgcgaattcacggtagatatccgcaccaacgaattttatacgaacgaacagttattcgagctaatcaaggaaaaggttcattgcgagatcaaggcccgcagcttccgccttagctccacccgcacggatctggatcatccttttgtgcgacgggcgatcttgatgggaaaagagcctttcggctctcctacgcttagcgaccaagccttgatgcgtttcccctccgtaaagataggaccgggaaactcggcacgttcccattccgcagacgaatacatcaagggaccggagatccgggaagcgatcgatacctatgtaaggttactgaatggattacaactatagcttatgttaaaaaagatactggggacaataggctcgcgttatctgatagctttccttaacctagcgctgatcttcattaatgcgaaggtgctgggaatcgagggcgtggggatgatcgggttgatcgtggcctcggtaaatatagcggtaatcgtcaatgggattttatgcgggaatacgattgtctatttcatgaatcgttactccatgcggacaattttccttcccgcatatctgtggacacctatcggctcttccctagcttgcggcttcatgtatcttaccgggcttttacccaccggctatcggctggatatcttcttgttggcgatcttgagctctacggtaaacgccaatgcccgcttcttgttgggtaaagacaatatcaaagggtttaatctcacgtttatattgcaaggaggactgctatttttcgtcttactctatttctattatatattgaagcgcccggacgtacggtcgtatgtctggggattatatgtcacgaacggcatagcctttattgccagcctatcgatgcttgttccttatttcttaaaggagacatcccggtcttccggcaaatcactctacggtctattaaaagaaatgtttgcctacggcctgtgggccggtgcggacgggttggcggaaacctgtactacccgactcaattatttcttgatacaacgtttcgccgggttgggaagcgtaggcttgctagatgctgggaccaagatctccgagagtgtatggaatattagtcgcagcgtaagtttcatcgaatacagtagcgtggccaagacctcagaggcaacggaacaaaaacgtattaccttacagcttttcaaattgaccttttgcgctttagccctcgtgatgggatgtatcctattggtaccggaatggatatatacggattatcttttcagcgccgagttcaaaggcatacgtaaagtgataggcggattatcgatcggaatcgtagcgttaggctgcaacagcatcatcagccattatttcatcggcagcggaaagatccggtacagtacggcaagctcgtgcgtagggcttattgccttattaatctccggctttttactcatcccgtcttacggggtcgtaggttccgctatcacgaccagtatcgcctttacctctatgctggttttctcattgacggtcttctcccggcaaacacttacacgctggaatgagttccttccgaacaaaaaagacttccaagcttgcagaattcatatacaaaaatccttgtaattctatcacgaattttatcgataacgccatcaagttcacggaaaaggggacaattacgcttgaaatgatttcgtgcaagatacaggtctcgggttatcaaaacatggactgtaccttataaacaaactccatccaaacccaataacggatcgcttttcctaagaacatggagatcgccacgacccatatattagcccgcaagaaacctagagcgacagcgataaaatcaccgataccgggaagaaaaacaaagaagcccatccaagagccttttcccttgatccaatcctgcaccttctgtagttttaccggatcgagtttgaggtatttctcgatccactctacctttcccagcatccccagccaatagcagctcattccacctaagaaattaccaagcgtagcagcgatcatgcaaggccaatatgccgaacccgccaataatacacccgtcaatacgacctcgctgctaaacggtaagatcgtggccgctaagaaagaggcgataaacaccccgatatacccgtaggctataagaaattccatatacgtatcattaataatgcgataaacataactaccgagaaatggaacagccaaaagatatatttcccccggttcaccgtaaaaaaatgggcgatcaggatagacgccggtacacaggccatttccagaaattcctcggacgactgctcatagataaagaacaatccaaacgaccaaatggccatgacaatcagaaaagaaagaaactgacgagtacgcaaattatcctcatactcatgtgtaacgatgtttaatgaagcaatgatcgttaatcccgccactaaaacaatctgtatccaatctataattcccgtccctagtaccgcaaggaaacggatcttgaataaggaggtgaaaggtatggtaaataccgtgaaatcccattcccagacacaccatccgaaaacaaaccaataaaccgtcaagattccgaacaaggaagcgacaaatgtccggatattcaatgtcctgaaattatacattcccaaccaaaacagcggcaagaaccaaaggatgtgtatccacaacagacttccgatactgataatcaaggatgcgttataagccttatccgtagcgtccgggtcatgataagaggtaaataactgataaagggccaatatcaaacaaaacaccccgacagatgttgatttcaagggaaagaaatccgggtttgtacttgtcaacaaggcatagaagagaaagggaagcaatgtcttctcacgaatcaacatcaacgcatagtttacccgatgcaccagaaacgcaccaccggccatcagcaaaaaaccgatcaaataggtaaacaacttacccggaagaaccagacagagggcattccataaaggaggagccgtcacctctccatacacgggatagcctaccgaatccacataccccacgatccaacaaaaaatacaagcgcaaagcatgtacaaatgggtcataggtgtcgctatagtatatctacgtccgtaatatgaagttgttcctcttgccataatcttatcttagtgtgaaaatacggtacctgcgttagtgcaagcaccggagcgacgttcgtagtgaacgccgaccggtactcaccgtaaacgccgactgacgttcactgcaaatgccgaccggcgttctcgataaacgcaattataaatcaaacccgatatcccgacggaaatacttcttatcgaaatcgatctgcttagctccggcgaaagattgggccaaagcctcttccttagtagccccatacgaactgaccgcgatcacacggccgccattcgtcaggatctggccgtctaccagcttcgttccggcatggaacactatattgttcgaggatacgccatccaatcccgtgattaccttattcttctcgtaagcctccgggtaaccgccgcttaccaacataaccgtaaccgccgcacgagggtcctgtaccaatgtacgagccgctaaatcgccttccgctaccccttccagcaaatcaaccaaatcgctttggatacgaagcatgactacctctgtctccggatcgcccatacgacaattgtattctatcaccatcggctcattcttcacattgatcagacccaagaagatgaaacctttataatcgatatgctccgctttcaatccctctacggtaggacggataatacgctcgtccaccttcgccataaatacctcatccgcaaaaggaaccggggaaacggctcccatgccaccggtattcaagcccgtattgccctcgccgatacgcttataatctttcgctaccggaagcaccttgtaatcgttgccatccgtcaagacgaatacggagcattcgataccatccaagaactcctcgatcacgaccgtcttgctcgcgtcgccaaacattccgcccagcatatctcccaactctttcttggcttcctccaagttatcgataatcagtacccctttaccggcagccaatccatccgctttcaatacataaggagcggaaagagattccaagaacgcatagccttcctctaggttttcagtggaaatactcttataacgagcggtcgggatatgatgacgcatcataaacgccttggcgaaatccttgctaccttccaattgggcaccttccccactcgggccgatcacggggatggagcttaatgcctcatccttcttgaaataatcataaacacccttcaccaatggatcctcgggacctaccacgaccatattcacttggttcgccaacgcaaaatccttgatagcggcaaaatcatccgctttaatatccacattggttcctaccaacgctgttcccgcattaccgggagcgataaataacttatcaactttcgggctttgagcgatcttccaagcgatcgcatgctcacgcccaccagagcctaataacaatatattcatatctcttctaattttcaattctcaattctccattttcaattcccaaggtagtcatcgaaatacctcgtaatcttctcatgcaaatgcggacggtccttaccggtcacattatgctcatggcgaggatacacaaagtaatccggatacgtatcagcctctacgcaagcctttaagaaaccaaggctgtgttgccacactaccaccggatcgatatccccatgtatcatcaacagatggcctttcagattaccggccttcagttttaggttcgcgttcttataaccttccggattatcctgcgggcgatccatataacgctcgccatacataatctcgtaattgctccagtcgataaccggccctccggccacgcccaccttaaagatctccggataagtcagcatcaagttcgttgtcataaaaccgccataactccagccatgtaccccgatacggtcggcatccacataagacaaagatttcaggaactcgacacccttcacttggtccgccatctcattgatacccaaattacgatgaatcacgctctcaaaagcatgtccacgatttgccgagccgcggctatccacggtaaacatcacataacctctctgtgccatatagaggtcccaaccacgagccccgttttgccagtcgcccgtaacaagctgtactttagggcctccatatacatagacaatcgtaggatacttcttcgtctcatccaaatccggcggtaaagtcaaccggtaattcaagcgagtcttaccatcggcagcaaggatatgtccaaccttgatccgcggcatccgatacgatttaaagggatccggagcagaaagtaaggtagaaatcaccttagcgtcctttatacggactaaatcgatatccctcggggtagaaggagaacttacataatcaatcgcatattcgccggagggactcagcaaccaacggtgcacgcccactttccaactcaagcaattcatgatatcacccgttctcaaatccgtctcccaaatataacgttgcatccccgttccttgcatattcggagatacgggatgaggtgccgttccctcgaaaatcaccttatttccgtctttgctaaagcctagcaccttggtaaccacccattccccaccggttagcttccttaattcctttccagtcgtatcatacagatatagatggttatagccatccgcctcactctgccagataaacttatccggatcgttcggcaagaaaagcacgggatgctgcggctccacataacaacgatccgtctcggtaaacagatcagcctctttctttcccgtcaaggcagagtaccgcaccaaatgcatctcgttctgctcacgattcaactcagcgatataaatactcttctcatccggactccaagcgatatttgttaaatatttctctttcggcaagcctgtctccaaccaaaccgtctgcccggtagctacctgatagacacccaccgtaacctcatggctcttcattccagccatcggatatttatgaggaaccggcgtagcgcaacgagtatcgatattcaccagcgggtaagcggtcaccatacgctcatccatacgataaaacgctagagccgagcctttaggagaccaaaacatacctttcgtaatcccgaactcccgttgatggacagcctgtccgcatacgattccatcctgtgtttcacgtgtaacaatcgtatttcgtccatccggggataaaatatgcacattgtttccctccgtaaaagctaagttattcgtagccgggcaaaagtcataattcgcccagttattcttcaaagcataatcagcgactaccttattcttcttatagtcataatgaatccggtgctgtttgctagtaaaagccaagaccgaacctctttcatagggtaccgaaaagctaggcaaggaaccaaccgtctgcagatttgccgccgtcaaggccccattcagtctttccaacgaaaaaaggacctcttcttttttccccggcttagctcctaacacgctatctcccttaacatataagtactcgtccccgcaccatcgtaactgtttcaagtcacgaggtacgaagcggctatacgtcttccctccaggaatcaagtcgtgcaaggagagttgcttatcttgggcggtaatcgacatcgttaataaaatcagacataggcttatgaataaagatgatttaatcctcataatcatcataccctctccgttttataggctttataggtttgctaaatgggcgctttccatccctcttatgatcgccaaaccctttcttacggtcatcctcatcccgataacgcattttcacaggacgttctccttttggcttgatcggcttacgaaccggggcatccacgaatttcttgcggaccggacggtcctctccccgatcctctccaaagatacgtttccccggaatggaagcgaaacgctcctcatcatcctcgctatgggcagcggcgaaacgacgctccggacgatccacacgacccgtacggaagtttggacgatcattgcctctacgttcgaaagagccttccgatctgtgcggacgctcctttccatcctcattcaatgcctttttgaagtccttattggttccctcaaataactcatagcaacggtattcgcactccaaggaaccattcatcaatttgatcttctcgctcgggcgcaagccgatcttatcgaaacattcatctttatagctcaaaatccaagccttatatcccatgaacacatgtttcaaacgctcgccgatcatattatacaatcccaatagatcacgagatgatatacgctctccataaggtgggttcgtcaccaatatacccggcttcggagcctctgtatattgttggaacggtttcaccttcagatcgatatatttcatcaagccagcgctacggatattctccaaggcgatatcgatagcggcttgggaaatatcggagccatagcaatggaaagcgaactcacgctccccgctctcatcattataaatacgatcgaacaattcctcatcatagtccacccatttctggaaagcgaactctttccgatggatacccggagcgatattcaaggcgatcatggcagcctcgatcaacaatgtaccggaaccacacatcggatctacgaaattagattctcctttccaaccggtttttaggatcatgccggcagccaacacctcattcaacggagcttccgtttgatccacccgataaccacgcttgtgcaaagactcgccggagctatcgatagataaggtacaatcgttatgcgaaatatggatattgatatataagtccgggttattgacacgaacggacggacgcttcttgaacttctcgatgaaataatccacgatagcgtctttcgtacggtaagcgacaaacttcgagtgattgaaatcctcggaatagatcaccgagtcgatcgcgaacgtcttgtccagcgacaaatacttctcccactctacctttttcacctctttataaacggtatcagcatctttggccttgaaatgataaatcggtttcagaatgcgcagggcagtacggcagtggaaattcgctttataaagcaattccttatcacccgtaaaggaaaccatacgacgaccgatctgcaagtcgttggcacctaaagctaataactcctcggccaagatctcttccaacccgtatagggttttggccaccatttcaaatgtctcgctcattttaattgaaaattgagaattgagaattgaaaattattcccaattgcgtattacgttgtttattattaattattctcatttcgctctctgacatgcttcgatctccttccagctaccctcttgataattttcaattctcaattttcaattgtgtaaccgtactccctgccggtacatcctccgctatccagacgttaccacatatcgtagcccctctgccaatccggattttaccgattaaggtggaattagaatatactgtcacatgatcttccaagataggatgacgggctacgccacggatagcgttaccgttctcatcggggggaagtttctctcccgccaagctgacgccctgaaagattcggacgtaattgccgatcacgctcgtctcgccgatcaccgtacccgtcccgtggtctatcgagaaatgatgaccgatcttcgcgcccggatggatatcgataccggtctcggaatgtgccatctccgtaatcatacgaggaatataaggaaccccgagcttatacaattgatgggcgatccggtaattaccgatcgcccggaaaccgggataacaaaatatgacctcacctagattttgagcggcgggatcgccattgaaagtcgcctccacatccgtagccagcagaccgcgaatctccggaagcgtagagatgaaagcctccgaaatagcctctgcctcagcggagatcttttcttccgggcaagtcacgcaagatgtatccgcgaaacaaagtcccgcataaacctgcttggataataaagaatgaagagtctcaacatttacgcccgtatgaaaacggatcgtctgtttactgatacgggcattcccataataaccggggaacaggatcgcacggcatagatcgatgatctctttcagcacctcgcccgagggcaacgcctcctcatccctgtacgcatggaacaattgtttatacgatgcctcatccgatagcttctccaccgtatcgcccaatacgctactatgcctctgtatatccattatttgcggaatattctttataatgcgcaaaaatagtattttatttgagaacaccttcacgaagaggcatcaaaaatacagccaacgactaatattacgttctatagcgctaaattccacgccaacctttatcaacttacgcccatccgcctgatagagttacaaataaataatcttcatatcgaatactttaccacatccaatgctccactttcatcaagagccaaggcgaccagaaaacgatcggaagggtctacggcaatcctctttattgaacgatcaaaattcaatcgtttctttaattggccgtcccaagaaagaaccagcaatgtggataaattcgaaaaatccgcagaaccatcgtacaagcaatatacatactgatccgtaccgaatatatcgataaagcattttgtcgttccaagaacatccacttgggtatcattcttcttcagtaaaggcacgataggctccttcccatacgtaaagctcctttgataagttcccttcaaatcgtaaaaatcaatttggttgaagaaacgcaaggcagcaaccacactgttttgccgctcattcacacaaagattaggcaaataagcgacgtgcttacaagaacgatacgttcttgctacttttggtggctccacccaataaattccctcttcccgattcgcatagcagaaaggaccataaacatttttctctacgatcggaaccgcataaacttctttcgtggtgacattataatgcgtagagggaacaagttcgggtattagtatatatttccgatcaaaacgcaaagaatccgccagcacctgcatcttattaaatgtaagttggttatccacgatccagaactcatcctttccggcgggttcttttgtatttgacttcataaactccggattagagaaataagtggcaccatatcctttcaacgcaaacgcatgcaggtgcgacaaatcatctttgtcgaatacttgaatgatcgtatcacacccacgagccaacaacaccaaataagactcggtaagaccaatcccatcatagcatacaccagaatcccctttcattaacaaatttccctccagccgtttttcttctctttccgcatcggaacaagcgagaagaaacaaagcgaagaatacaataatcccatacaatactctcatgacctttctattttagatttttattggtttgactcaaccgattgaagaataaacttttagcgaattatttgagaaatagaggtaacgagttggcaaccgtgcgaatttcagcgttttgcgttgctgtgctgtcaaataactctttttattacaaaagtacgaattattttctacaatgcaaattcctaaaggtaatgttcgtatatcggggacttcctcttccataattatttgttttgcattgaaaccctgtcatctaccgaagaaataagcagagaataaatgctatccaaaagattctcatttatgccgaaacaacgcaagatagttttatcaaaatttattcggtcggcttttcgcacttccttaaatattgattctatttcgcggtgttttaagggttgaaatgctactaaaacatctgatttctgcgcatcattaagtaaatcaggatttaatactttcagttgttttagataattagcgtttagatctaatgcgcctaaattgcgtgaagtgcctcgcatttcgagtgttaagaatgtaatagcagaattgaataaggcggcaattagctcaacatcataaccgtcttgtacacacatggcaatcaaacgttggtctatcgtaaatggtgtttgcgagaaggtgaaaaagaaacgttcaaacggatttattgctgttatgatacttgcttgtttggggcgaagtgaataccaataagggcggtgtccggcacaagcctgttgtattgtttggctgccatttttgttttgtgtgtttgcaaaacgttgaatccacgactttgcaccattgggcaaattgtctatttcatctggacaaacgaataatcgaaattgatagttttcatcaaactctattcgttctaattctgttgggctttttacatacggcaaaagatattggttttctattcctgaagatgcaacatctctttcgggtattacaaacatttcattccaacctgtacgttctccacgaaaaacatttataacattaggatataattgttttaacgaactgtcgaaactttcaaataggttagcagaaataaaatactttgcccaattatccttgtcggttatggactgtaataatttatgtttaggaacaatacaaacagaaatacggtcttgctgatttaagtataaatcgttgaaagttgaatctttattccacttattattgtgggtatcatcgcaattgtctatttcagtataaaaatcttctatttgttgtatttgacttgctgtattatcctgagaaaaatagtctttcaacttaaaatcaatagttacaaatcttgtaggttcttcatttgcccctttttgaaataccgcataaacggtagaaacttgagaatcagaaaaccaatgttcggcatagcttttcactacatatttgatatgaaagttgtctagtaaaaatttcttgaactgaaatccatattctttaccaagccaagcatttgaagttattatagataaaacgccgccatcttttaaaaagcggaatgagttgtacacacaataagtaaaataatcagaacgttcattgattttgaatgttttatctttaagaaatgcttgttgctgtgcttgaaactcgcctctgaaaaagttggttaaaacatcatttggaatatcttcttgctgaataaatgggaaattacttgcaataccatcaaattgaggtatagctaattcaatgtgtttcttgtaatcttttgaatcgggaaaacttactttgttacctacattcagattaaaaaaatcgtcacgagtaacacgaggaaaattatccgtttgtgttacatcttgtttgtacaaattgataaccgaaagaatggtgggaaaatgtgaaacatcgttaccccaaatgtgattcagtaagtctgaatgattggtatttccatgaaacgccataatcttgtaaaaagcgttcaagaatgtacctgttcccgaagtcgggtcaaacaaattatcttggttagtttgtacggcagggaaagccacaagattagccaaagtttcaggtgtaaagtactgaccgaatttttgcttttcctctttgggtacaaggttttcaagaatatttccgattacagcagtcggcaatattctaaaatcaaaatcagtaaaaatatgaattaagtcaaataaagccttgtttgttgtggcagaataacttatatcgtctgtaaaataaggtttaaaaattgcctgataatcaattgcttttgcttggtcaaaatatgagaaaagtgttgattttaaattggaaacatctgttattgtaatattttccaattcgccacttaaattttcgcataaagtgaggtaaaaaagggtttttccaatcaaattataaaaagtaaatttcgctaaaatttgttcaggtacaaccgtttctgcacgacgggaagaagaagctaaaattttcaatgttgaactttcataaattttccattgattgaactcctttctaaaatcagcattgcttcccttacattcatttattgccttttgaaattgaggaataattatattggaagcactacggactgcttcaataatatttcccgtaatatttatggcaggctttaactctcctgtcgtgtataattgcccaaggtcgtgcaaaatttcatttgcccgttgctttaataatgtctcgttgtgggcaaactttacaggatctgcaaggtcatcacgggttgaaatagaacgttctttttgatattccttaattttactaagtgtatctatggaataattatcggtgtctattttccaaatcacagcttccgtgccgttccatgttacgaatgaatcggattgcaacttcttcgccttttccaacgcattgtcaagcattacggcatcatcaacagcagtatcaggaaatttaagttcccagccattgaaaataataccagatactttgtcggtaaataacagaacatctggaaatttagttcttcctgattccattttaacacctgtatcgtttgtggcatcttcaaatacagttgtgccgtgttctatggctgattttatccaacttataagttgcccagcccaatctctttcattcctctttattgtattagtcgccataattatttagcagtggttaatgctgttgttgtgtgattatcaaacgatccatattcagtaacagtagccaattttgaacgtaaaatttcatttattctatcgttgcaaacttttatataatcaatagactttgttttatgaagtaagacatttttgtttttttctatgcctatataattacggtgttctaatgctgctgctactaaaaaactaccactaccgcaagcattgtctaatatagtatcgcccggattgctgaatgtgcgaataagataacgtcctaattcaacaggcttttgtgtagggtgataaacttttccctctgattccgctgttttaaaatacacgaaatcctcaatattttgttcttcataacaaactacatcattagggtagcgttgtccgttactttgaacatggcggggcttaaaatcgccatagctgcctgtgtattggtctttgcggatgcctttgtcataactttcgccctttgtcatttggggattgtatgtaggttgatttttataaaacacacaaatatcctcatgtttgcgaagtggttgtttcttagcattgagaaagtttgtcgatttcgattttatccatacgattttatatttgaaccaactttcgttgcttattattagtttagcagtaaacagaccttgcgcagttaaaacaatagctccgttatccttaataattcgagtatattccgcccaaagtttttttaggtctattactgaatcccatttattttgcgttgtaccataaggcaaatcgcaaagaatcatatcaatggacttgtcggggatatttggcataatttccaaacaatcaccttgtattacttggtttatatatttatttttttccatattcaaccatattttcttgtactacatttagaactttgttggcgttattttcaccttttaccacagtgtaaacttggtcggcaagccaaagagtaagcagttcttcttggtcgactttgagtatttcggcaagtttaacgacctgttcacgtttggctcggcgttcaccacgttctattttgctgtatagaccattgtcgatttcgagagcagcggacagttgtcgttgcaacaagttgttttgctctcttagctgtttgattttatctgcaaacatcattggtaatcttttgacttgacaatttttgtacaaagatacaataatcttttgaggtatgggaatgtttgaacaaaaaagttttcaacattgtatgttcctatggggcagttttaatataactgccgtgcgccttttccatgtgcaatactacgaatcccatatcatatttcctttcttttttggcttgtgaaacattggtttaatctctctttgagggcggcaaatgccgccctcatggggtgtgcagaggggcttgccccttgccttattggggaattttcagcgatacgtagtattgcggctcggaaaattccctaataagctacggtattttccccgtaaataccctgcggcgtgccgtccgtctgtccgtctgcctttcggcggtggctgtccctgccgcctgcttgcccgtaacccccaccttattatttttccctttcggtcggtggtgggcggcggggcggtcgtttccgttttcaaaggctcttttgcacggggcggtcggatacaaggttttcccgataaatacgctcgcagcgaagcgagaggaagatttatcgggaaacggcgcagccgcctgaccttttagccgacataaagccccgtgcttgctttgcctttgtaaacggaaatgattgctccgctttcctctgaaaagaggaatagaacctgcaatataatatatcaccatagtgataggtttgcatgctggtatgctggtacgtttgtatgttggtatgttgatatgttggtatatcatcatgctttccaacggctgttgggcttgccgtccgaaacaaccgatacgaataccgtcgttttctcttttcgcccgtgtataatcctctctaataatgccctgcggactttcgccgccccgaacgactcgatacggaaagcgagggcggctatcgtttcgaggttgtaaacctcgatgtaacttctctccggtaagcggataaggcgttttatgccgtactctttcaaaactccgcttttgcagagtgcctttatccctgcccgaaccgtcggggcgataaccccgaacagttcgcagatttcccgcacggtcatggcggttgcacctatatcgctcggcagggagatattgccctgcccgtccatcgtgataatgttcctttcttctttcatcgggattctgtttttaattagatggctcggcagatattcttctccatatcctctaacttgtgcgacaaggtttccatgtcttggcttatcttctgggcggtgattttggcgtaaatttgggtggtttttatgttcgtgtgtcccaaaaggcggctcaccgtttcgatgggtacgccgtgcgacaaaagcacggtcgtggcgttcgtgtgtcttgcaacatggtaggtcaaacgcaccttgaaaccgcattgtctgcctatatctttgagtattttgttacaactgccgttgctcggaacggggaaaacatgaccgtcccgagccagtcccttgtatttctctatgatacgcttgggaacgtccaaaagacggatgttcgattcggtgttggtcttctttcttcgggtgattatccacaggttgccgtcgaagaatgtttgcaggcggtcggcggtgaggttcttcacgtcggaatacgccaaacccgtgaaaacagaaaagacgaacaagtcccgtacaagttcatgggtggcgttcttcatcggtgcgtccataagcgtctgtatctccgtttgggtgaggtagcccctatccacgctttcgggagagttgatatatccggcaaagggattaaagggcaaacgcccgtcgtttctcgctatcgaaacgatgtgtttcaacacaatcatgtagccccacacggtattggtgcggcatttcttctccgtgcgcagaaagtactcgaagtcgttgatgaacgtgaggttgagttcctttaacggaatatcctcacgcttgtaggtatggggcagaaactcccgaatatggttgcagaccgtccgataacgggtaaatgtcccttgcgccctgctgtgcccgacctttttggcgaactcggcgttgtgctgttcgaacagcttcagcaaggtttcctgcttgacgccgataccgagataggcatctttgagcttggcggcagtaacataaccgtccgtctgcatcagttcttggtagcggcggtttacctccacacggattttatctaccgcaaggttgattctctgcgcttcgatgctcttgcccgaagcacggctgttcttcacgtcccacaaccgtggggaaacgtccagcttgcaactgaactgtttaatctcgccgtccaccgtgatacggcacatcaaaggcaggttgccgttcggcttctcgctgcctttcttcacgtaaaataataccttgaatgtactacgcataactcactccttttttgggttacaaaattagttattagtgagttaccgacagctatgtgaaacaacgcaaaacgcagaaacagaaccttttagcaagaaatctgcacccgttacgggagtaacgaggtggtaactgaacttctgcaccgtttggcttcgaagtggtatttcgttggctctgccccatagaaaaacaaagcgtaacgaacgctctatcagctaattcgctacgctttgcccaaatttactttttcgttatgtgtttattttaaataaacataagatcggattatcgtcctgtgtacgattctccgctatccgtctcaaatcctcataatgtatctgattacgcaacagcaccgtcgaactgatcttcccgataaaataatctttatacactccgcaaataccgtaaaagcctgtcaaccccgtagcccttatgaagttggggaacgcatacgagaatgcctctttcctatccttgtcataaaatccgaagtaagttaccttatcgcacatataggtcgcatgcaggatctgttcggtctccagcagcccaaaagaatttacatagccggagcgaaacagatcgccagagaaatctctcccgcctctccctttctccttgacatactcgataggaggcatacttttatctccgaagcgaactttataagcaggctccaacatcccgtccttcactttccacacttcgggggtaaaggggaaatgcgcataccaatccccagcaaaggcatgcaacgtcttgctcccattgatcgtatggccggacgtgaaataagccggtcccaacaatgcgtcttgctctcctttcctgtccgtggctttcagatagaagttttccctttgcggtgtcgcaaatcccaaaggataataccaaatccaattctccttatccaaaggggcgcagtccacaaaataatcagctacatcttgcgtggatatatattgataggtatccagatcataacgcaataaggccgtcccaccaaaatccaccaatgtcaagattcgctctttctcatccacgaaaaagtgagttagataaagatactcttccggcccttgtccccgcaagcctacacgagtaataaaatttccttgatcactgaatacaaaaagcgcatttatctcatcacttctatcgaatacaaaaatacgatcgtccacccagcaaacccggtagagatcttttaacagcacgctatccttcgtctccaaaggaatgaatctgcattccaaatgttcctgcaagccaaccgtacaatcgtttccgaaatccaccacgtcccactcttccgatcgattctcgcatgcgatcaaaatggaagccagacttatcatcactaaataatatagttttctcatgtttttcatattagattcagaccactaatatacgtaactttttgaaatacgccaactgcacaagttttcctaagcgcacaatcggaattcacgagaagtactacttccttggcctatgaagtatatctcttagggatacagtgcttattttccacatagttattgtacatttttccaaatgcatttaaaacctcattatctgtttcccaaaacacgtacgtgttttcacaaattctcgtacatgtttccggaaaaacacgtacatgtttttccggaaacatcatcaactttttatcaatctgattataaagacattatcaatacgtatattttaaatacttactgtatttttcactatcaacaaaacaccttatggttatgatttttgaagccccaagaaggctttatttacgagcttatcgacttccttatacagccgttgtatttcctttgtatccaatccattttgttcccactccgtcttatgagcgtcgaataaatcgaaaatccggttctctaccgcacgaagctgttggatataaccagattggtcatcattccataacagttgccaatgcaaatacttttggccgttgccacgatgtatggagtagacattcttctgtaattgaacggaataccaatctaatagggctgttttataggatgcgtcgtaagtaactaaagcactttgctcctttcccattttcacccaaagaggaatagcgacagaggtaggaggatatcccaaggcagtccacatcgttgtcaattccggattcataccggattttacgccttggattacgatagaagccgtactttctagacgggggatgaaatcctgctccacaaaccagcctgtacgattgttcggactttgtcccttgtccatcaaatcgatatccagcaagctattataaaaagagcgggaagcctgctgaaagatacgctgaggagtaaatccttcgttccgcatttccttaaagatctttttcgcattctcataacgtacatatcctttgccttcatccgtacgcccctcgaaagagaaattcgtataaatcaagtaaccttccggcgccagattcggatcattcgcgtctttcttataatatcgctcattattcgtctcataataagccgcaccaccataagcatcgatcactccgaaattagcctccacacgcatcgggcgaggcaaggtatccaagaaatgctcgaaatcctgcaccgtcttacagactctcaaggcttttcgcatcaagtttccctcttgatccatctcctttatatcatcgtctttcaagttataagaagccgtattcatgatagagaagcccgtctcattgcttccggtccacacggctccctccggatcatcgctatttaccagccccagaaaacgataaccaccttcgtcaaaataaccgatatggttatacggagcgccggtatcccggtgtttccacatcaacggacggccatcgggagtagcctttccagtgattataatggaggtacaagccttgtcaaccaccggaaaacaaagacatagaacaaataaaagaagtagttttttcatatcatttattgatttaataagatttcttatgaggagcgccaaattccttacagctgacctcgtctatatctaccgtccaaatcttcacgttacggaccgccggatcgctataacggaaagtcttatcggaatattgcttcatgataatatccaaggcttccaccttcttgtcgaaatcctcttcgtaagcgacctttccccaagcgatcacgctcttcgaacgcatacggtagctacaagctacctccggatgctggaaaaccaaggcatggtcaatactaaacgtaatacagactttcggattacgttccaatatagagatgcttcgtccatcctgcgccgagtgtaaataaatcacgccatccttataaccgaaattcatcggcaatacataaggcgttccatctgtatccgccatgccaacgaagcaaacatcgctctggcggataatcgattcgatctgttccttgtccgtgtgtataagtgtcttcatattccttatgtttaaatctaacttgatgcaaaattaaaaaaatcatctgtttctgcaaccctttataacccgcactcgtctattaagaaaagaacctaaaaaattaaagacgatgaagacgagagtatcactttttatattctgcatacagatgatcgcggtttgcggattcgcagccgacaaacgtatcgatggaaatgggaacccggaaacccgggagataaagattagcgattacgacgagatcacgttcgttggctccgctgatttcgagtatgaacagtcggataaagcgccttatctatccgtaacgatcgatgagaacttatttgattacctcgtgaccgaagtagaaggcggtacgttaaagatctatccgaaatctatcaagaaaggttttaataataactcctacgacttgaggccgaccgtctacaagataaaatccaactccaaggaactaaaagagttgaatacggtaggttccggcagtttcattatcagcaaaccgacgaaagtaaaccggatggagatcaatatggccggtagtggaaacgttgagttgagaggccccgtaaaaggttacaagcttgaatgtaacatggccggtagcggaaatatcatcgccaaggatatacagctggacaacctatcttgcagcctcgccagcagcggggaaatcgaggtaataggaaccgtagatcgtgcctcattcaatgtagcgggaagtggtgagattaaagcctttgactgccaagcacgtaaagcagagtgtaatatcgccagcagcggcgagatcagcgtatatgccacgcaaatcttggatgccaatatcgtaggtagtggtgagattcattacaaaggagatccggagatcagtaagtctatcatgggttccggctcgatcaacaaagtcaaataaacatttaatacatacgaacgatgaaaacaaaattagtagcggtaatagccctcatcttttgtgccttcatggcagaggctagtaaagtagaaggtaatgggaatattattacgaaagagatatcggtagataactatagcgagatcgaactgggtggaaatatcgaatattccggcaataatttttggggaaatagaagcaacaagaaattcccggtattcaaatatacgcatggacgaagcgcttccttgaaaattacgatcgacgagaatctattcccactcctctcgatcaaatccaataacggacggttagctatccgcatacaagacgggacccgtatcaaaccgacccagtatgtaatcgaaggaagctcgaagactctgaaatacttaaagacttccggcccgatggattttgaggcgcagaacgctttttccgaggatcaactggaaatcaagatttccggctccagcgacgtaaagttcccacataacgtgaaattacgattaggtgagttctcggtatccggctccggcgatctggtttttgaagatttggactgcaagaatcttaccagcaaggtttcaggctccggagacatcaccttgaaaggtaaggcggacgaggcccgctattccgtatcgggcagtggagatataaaagcatacgacttatctgtcaatgatttgagttgctcggtaagcggtagcggagatgcccgtgtttatgccaaagataacatgaacctatcggtttcgggcagtggagacatccgctataaaggcccggcgaacgtgaataaatcaaagtccggctctggatccattcaaggcgcaaattgatcgaacacacacattttttttaatacacacattatcaaatttaaaaaagctactagatgtgatatccggtagctttttcttgctatttttgtaaccaactctttatttatagagtctaaattaaaaagtagaatcataaaaaacgatacttatgaaaacaaaggctatcttattaatggtatttttcctaggatgggtcactaccggttgggccgcagatcatgtaaaaggcgatggtaaattgacctcgaaaaagatttctgtcaccgattataacgagattaaggtggatggcgtaattgatttcaattacgagcaatccgatgatccttccaccgtggaggttaccgtagaccagaatcttcatccctatgtcaatatcgaggtgaaggatcgtgtcttaaccatcgctttcaaaggagcgaaggtagatcatttcacgaagtttatcgtaaagacgaattctaaatggcttgccgccgcaaaagtttccggaaatgccaacttcatggtaaacagtccgcttaccggagacgagaccgttattaaggcgaacgccaatagcttggtgcaactgaaagagacagttacggtcggtaaactggatttgaatgtatccggtagcgcaaatatggttgtcaatcatctggaagccgacaagatcgaatgtgatatcgatggctctggctctataacgatcaagaaaggtaatgcgaaagaaggagactacagtatcgtcagcagtggtgatatacacgcttttgggttagcggttcctcagctaagttgcaaagtaacaggcaatggcttagcggaagtacatgctaccgataatttaaaggccaacgtagtcggtaaaggaaatatccgttataaaggcccgacagcagttcaacagagaataatcggtaaaggtaccgtagaagaagtaaaagaatgaaaacaagaattatatacctatgtctgctggtgatcttttctacgacaggttgtatcagtaagaatgctcgaaaaggtatcaatgggaacaagaatattgttacccgcaccattcaagtagatgatttcgaggaaatacatctagggtccaatatcgaatcggcgaaaagcatcaatccgttcaacaagaagaaccgtgcgatatgtaattacacccaaacagatggcgcctcctcgttggagatcagcatggacgagaatttgtttgacttattggatatagagaataaggatcacaaattaatcatcaaggctaaatccggcaagaagatctgtccgacccatctggtattgaacacaagttccaagaacctgaaggaagcggggatcagtggcagcatcgactttatcgccgatcaaccgctacaactgacaaatacgtctttttatatcagtggcgtaggcgacgtgaaattagctgatttatcttgtgatactttcaaggtagctatatccggagtcggcaatatttacttgaatggaaacatcaagaaaggcaaatactccgtatcgggtgtagggcacgtatatgcgttcgattgccccgttgaggatctggaatgcgaagtttcaggtgtaggaggaatggaagtgaacgctacccagaaattagacgctagcacttctggtgtgggaagcgttaaatataaaggcaatccggagcatacgcagaaatccgcctccggtgtcggaaaaatcaaacaagcagattaatcatcccaaaaatcaattagatgaaaaagatatcacttttattccttatatgtggcttatttctagtaagcagctgtatccctacacaaaccataaaaggagacggcaatatcaccacggaaaacatcccggtttccgagtatgactgtcttgagttagagggaggaggcatggtcgtgaattacacgcaatccgacgctcctgaaggtttggaaataaagacagaccggaatatcttcgagaaatatgagtttaatgtagagaaccataagcttaagatccgtccgaaaaaagaattcaggaaacatacgaatttccgtccgaccgagttcatggttacggccaactcccgcaatctaaagaaactagcggcggcaggcagtacccatgtaaatataaattcccctctacaagccgaggagttcgaggcaggattagccggtagcgggattatccaattccacgacacggcctcttttacaaacctaaagatagagatcgccggtagcggagatttcgttggccataaagtgtattgtgaggaattaaacggggatatggccgggtctaacacgatcgttctagggggaaccgtaggcatagctgaattctcgatcgccggtagcggtacagtacgtgctttcgattgtaccatggatgagcttgagtgcaagattgccggtagtggagacatagaagcctttgtcgtaaacaaaatcaaggcagagatagccggtagcggttccgtaaaatacaaaggagatccccaagatatccaaaaaaaggtaatgggctccggtaagatcgagaaggtggagtgattcttacaaccacccctcctttttataccattcgatactttcttccaagcctttacgtaaaggataggccgggataaaacctaaatcatcttgaagaggcgtgacatcgcaaatccagttacgctgcttcaagatgatgtatttatcactatttagcgtcatacttttcttcaacaacttaccgatccattctgaacagtggcaagcgatacgcaccaatcccagcggtatacgggcatgcaatacccgcttctttcctaagatatcttgtatcatacgggcaaaagactcatccgtgtagacatctccgtcggctacaaaataatgccggttctctatctcctctttctcaagggaaaggaaggccacggtcgctaaatcttttacatagataaacgtgattcgctggggaatagcgcctacggcgaaatcgagtcccgactttacgctttgtatttccatgaaataatccttctcacccggcccgtatactcctgtaggccgcaagatcacgtaaggaaaataggtttgtttacggatgtagttctccgcctctagcttactttggccataagccgtgtccggccgctgcggatcgtccaagtgtatcgggcggaaagtcttctcgtcgcctcgcccatagctgcttaggctgctcatcaagaggaatttcttcggtttgcagccggcggcggctaaagcctcgataaatcgatgcgtattctcggcgttcacacggaaaaagtttcgcttatccaatgtcttcgtcaacccggcgttatggatcacataatcccatgccccatgctcacgggcaaagtctgagagttgagccgtaagcgcttcctgatcgccatatttcaagtcgatgaaatgaatccgcttatcttgcagatgcgctttactgctacccgcacggatacccgcccacgtctcatagccacggcgaagcgcctcctctaccaagaaaccgccgataaaaccactcgctccggttatcaatatcttcatatccttcatttttctttcatataaaatgtataataataccacaacaacccgatccaattcaagaacaggatcgtcagcatccaaagaatcttttgtttcttactgatgaaagggttttgcgatacggccttacatccgaacaggattacggcaatacctacgatataaccgatctccggcaagcttatccagcaaatgatttgtggtatcataaaaatagagttattcgtgaaaaagaattattcgtgttggtgtttcttcaagactcggtgcggcaagtcaccatgccccaccaactcgatcggacaagcgtatttctcgcccaaccattcctcagagacattcgctcccgggtgataatgcaaagtctcgtttacgcaagcgatatttttcaccatcgtcaaaaccgtaccgatatcatgggaaaccaagatgatagcgctctctttattgatatcttccaagagctgataaaaacgagactcgaatcgtttatccacatacgaattaggctcatccaagatcaatacctgcggacgggagacaatagaacgccccaataagacccgctgcaactggccgccggaaagctcaccgatggccctgcccgccaactcctccaatcccatctgtacgatcacctcgtctacacgctctctctgggatctattgaatggacggaacaaaggtttctccgcggataaaccggaagagatcacttcccgtaccgagatcggaaacttcttatcgatctggctcatttggggtagataaccgatcttcaaggaaggaacctctacattttcatcgtaaaaacgaatcgttccggaaataggaggcaatagacctagtatcacctttaaaagcgtcgttttcccgccgccattcggtccgataattcccaagaaatcatttttccacacatccagcgttacgttacgtaaggcgatcttattaccgtatccggcggtaacctctctcaactcaatcagcttgtccatcggctaacgattttgcgatatgaatcatttccttactccaatcgtaatccagcggattgatcgggatcagacggcaacctgtttctttagcgatcaactcggcgttcttctggtcaaactcccgctggataaacacgactttcgcattatgttcccgtgcggtctcgaccagttcctttaattgtgcgggagacggttcttttccgtccatctcgatgcaaagctgggtcaagccatattcgttagccaaataggtcagggccggatggtaaataataaatgtcttattgtcaagagaatgtaacaaaccggaaacggtcttttccgtctctccgatttctttcgtcagttgttcataattcgcttggtaatattccttattctccgggtccaaagacacaaaggcatccaaagtgttcttggcgatcaccttcgctccagagatagagctccacgtatgcggatcgacgcctccgggatgatgatggtggtggtgatcatgttcctcttcttcctcggggcttttaagtaaatcaattccttcggacaggtcaaaaaccttgagtcccggattattattccggatattatccatccaagcctgttcgaacccgatcgatccgatccttaaatagccttggcttttacccacctgcaccatttgctgcggtgtaggatcatacgtctccggactttgccctgccggaaccacacaattaatcttaaatttatctccggctatcttctccgcaaaataccgttgcggctcaatcgtcacggaaacgatcctctcatctgcccgcttatcgccgcaggccataagtatcaagacgaaaagagctgatatcaataccttaaattctttcataccacatatatattttcgcaaaggtaacgaatatcgggtaataaggcagcaaggagacgattcaaagttatcaggaagcagtctgacaaaatccccgtattacaaccgataagtaataatacggggattttatagggaaaaaataggctactctatttttactcggccagccatttattcatctgtgtaaggatccgctccttcatatcctccggcatattgccgatacgggcacgatggctgcctcggggctggatatagatttgctcgttcttcttgcctttgaaagcgggaaccatggccgcgctccacgggtcgatctcgccatagatgaagatcattttcggatcgttgtctttcaagaagttatagatcttgtggtacagagccggacggaagtctactttaccgaccagttcctcgggaagcatgatacggtttaggtatccatgggcgctatcgatcgtaaggtatttcttgaaaggttttacgtcatagccataataaccgagctcacgggcagcttgtacgaagaaagagatattcggctggttctcggcgaaataatcaggaccgctgatttccatcaaatgatcgaagagcgcctgatcgtcggcagacttggaagggatcgtacttaccgaagttccccactgccaaagagcgaatgaatattccagtacgcaataatccaatacctcgggcatcgggatacggaatgtcaggtttttattcttacaatagctctccaataaaggaagcatatcggacttacgcttcaagacttccaattgaaaatcctgtatcctctcgcgttccgctttcgtacctaccttacgtaagaaaggttcgtggcggccatcctctacacctttacataacggaccgacataaggaacggagaaatccacgtcgtccgggaaaaaggcacggtaaagcattgtagtctgcccccccttactgataccggtactgatccattttcccggatagatctgcttgaatgtattgcggacgttatgtaaatcgtacgcagagttctcggcggtcagataatcccagtttttaggttccggcgtcgactccaagaaataacggtactccacgaatactaagttcgcattcaatagtttagatagttcttcttgatatttcggattgagcgcataagccgctccatatccttcggtcacgataatggtaggacgatcataacctacatggcctacgataacccgttgcgtaaatgttccggcggcggggtctttcggatcgacctgctgagtaatacgtactacatatttctccggataataatcggattgaagtttttcaatgccactaattccttttagagcggcaagcttctcttgtaaatctccgggagcggccattaccgtcatcaccgacaggaagaaaagaagcaagaagttaaatgttcttctcatggtaatttagtcttttagatattgtattgttcgtaataatccctcatatttggcgcgtttcaccgccgaatgcgcaaagatacgattataatcctcacggctcaatgccttgaggtcgtcttttttaagggagagcaaagaaggggtgggatgaaaggctgctactgccgtaggcatagcgaagcggttccaaggacaaacggcttggcaggtgtcgcatccatagatacggttacctaaaaggacggcttgctcaacagggatttctccacgatgctcgatcgtaagataagagatacatttacgggcattcaaacgtttcggcccttccaaggctccggtaggacaagcgtccaaacagcggatgcaggaaccgcagtgattctttttgggggaatcataggtatcgactaccaaagttgtcacgatctccccaaggaaaaagaaagagcctttgcccgggatgattagattcgtattctttccgatccatcccaaaccggctttccaagcccaataacgctctaacagaggggcggagtccgtgaatacacgggcctcattgttggagggatgatgctcggttatcgctttccataattggcgaagtttatcctttacgaccccgtgataatcttctccgtacgcataatacgagatataaggttccgccggattccggagaactttcggataataattcaaggctactgagataactgatttggcaccttccaccaagccatccggattgagacggatttcccgatgattctccatgtatttcattccagcatggtagccttccgcgatccattggtcaaaataagcctcctcgctcccggccttcgctacttcagcgataccgcaagcggagaagcctaattccatagctttatcttttataaactgggagatacccattattcaaaaactttaaactcgtagccttcctttaagagccattcgacagcccggggcattgcctcacgcatattgcgctcggctttcaaggaatcgtggaagacgataacggaaccattacgggtatagttctttaccacgttgaagacaccgttcggagtcatatgagggctatagtcacgggtgaccacgtcccacatcacgatatgataatggcggcgaagccatactacctgcggaaaacgcatatgcccatgaggaggccgaaataaattgctgggaatatattcggccgccttctccacattcgccaaataattcttcgtccagaacttgatgccttggatatgattgaacgtatggttaccgacacggtgcccacgatctatcaccatctggaagacctcgggatgcttacgtacattatcccctaccataaaaaaggtagccttgatcccatacgtatccaatatatctaaaacccaaggggtaacctcgggaatcgggccgtcgtcgaaggtgagatacacacacttcttctctgccggtattcgccaagttacccccgggaacagtgccctgtaaaaccaaggcggttgttctataaacatactttgttagtcttttgccactgatccgtacgccatacggtaattatcaaattcctcttgataaggcttagcgaactccggattgtattgtttgctcacacgcaatacctcttggagaaccgccaagttatgacctaaatcactctcgacagatgataattgccccggacgcaaacggaaataccagtttatactgcgcaacgcattgtccgctatacctttataaaccatctccgccttctccttctggcccaactcgtaatacagctcacctaaagaaagagcgctataatccaacggaacattctcgggaggcaatacttccatcgccttatccaatacgttcagtgccttctcattcttaccttccgcaaccaaagcggcagccagcttgctgaacaatgcgatacgatagctcttgcacattcgcattacattctcatccaagtacacacccggcgtattgacaccaccccatttgaacttattcatcacgttgtcatacatcttctccgtattgatcgaacgaacagttccctgcgtctccatcggaacgatctgataagccataccggtctgctggaagtacggatccaatttcacgaactgatccgggcttacggtaatcgcgtaatagatcggacggttccagtcattcgtctgcaacatatccaagataatcaactcttgcttacccaagacatccttgcctttcaagtcaatcttcatctctttctgcaaatacggcaagttaacggtatcgatcacgccagcagccataaccgcggcggaatctacccccatcgtcaatgtctgcgcaggaatataatctaattcttgattgatacccgggatcttcttaaacttcggatcgttactacgaacgaaatcaagagcggtcttcagatcgatcgacttatccgtcatcgggaatacataagcggcatcacgagtaccttgcacataatcctccggttgccaagagattggaagcggatcggattcgtatgcttgcttcttcatttggttgatataccagtcggtttgcaaatagctcgtattacatacacgtacatccgtacggataccttccacctcctgtgcgtaccacaacgggaacgtgtcattatcaccattcgtaaatatgacagcgttcggctcgcaagattccaaatagttcgcaccgaaatcacggcaaacataacggttcgagcgatcatggtcgtcccagttctgcgcacccatctggataggaaccaacaagcagagtaccgtagcgacagaacccgctatcaccggagataacttgccatacttctgcaatcctttcgccaaggccgccacaccgaaaccgatccatatacagaacgcatagaatgatccggcatacgcatagtctcgctcacgaggttgatacggcgtctggttcaagtaaagcacgatcgcgatacccgtcataaagaacaagaagaacgtgatccagaatccctgaatgcccttctttccggcataagcttggaatagaagccccaagatacccaacagaagcggtaacatataatatacgttatgccccttattgttgataatatcgaacggcatatcctcttgcgggcccactaaagcctcatcaataaacggaataccggttatccagttaccattcgaaacctcaccgttaccttgtatatcgttctgccgtccggagaagttccacatgaaataacgccagtacatgaaattcagctgataagcgaagaaataacgcaaattctcggcaaatgtaggtttcatcaccgtcaccatctcaccgcaacggttgaacttcaccggtgtacctttcacttgtgcccactccttataagcagccacatgacgtccgtcgctactatacatacgggggaaaagcatactcaactcatccacgtattcgtattccgtatcgtaacgagagatataataatgatccttctcgtttttatctttcttaatgacacggctccaagtcggctcaccctctttcgatacaggtacacaagtgccgccttggttctcacgcttcacctcagaaacataggtctgaccgtagatcaacggagtcttaccgtattgctcgcgagccaaataagtacgcaaggtaaagatatcttgcggagcgttttggttcataggcgtatcggctgtcgcacggatcaatgtcaaggcataggatgaataacccactacaattaccatcaagcagaccaagatcgtattcagcatcttgatatttaccttcttgctcatgaacaaataagccgtcaaggcagccgtgaggatcacggcgatcacgtaaccactaccgataaacggaatacccaacaatacgatcgagagaataaaggatatcttcatccgcaccggatggatctcgtcttgcatcgtctcccagatcgcccagatcaaggaagccgccaatataattacgaacgcatatacacccgagttatacggcataccgaacgtattgacaaacaacagctcgaaataaccgcaaacctcaaccaagccttgtacgacaccatacatcatcaagcccacgatagcgaacgacaccaataaagcgatcagcgtccccttcatcgtaggattcgggaatttcttataataatataccagcacgatagccgggatacacaataagttcagcaaatggacaccgatactcagacccatcaaataagcgatcagcacgatccaacgatcggcatgcggacgatcggcggcttcttcccatttcaggatcaaccagaataccaaggcggtaaacaaggaagaataagcatatacctcgccctccacggcgctaaaccagaatgtatcgctaaacgtataagccaaagaacctaccaaaccgcaacccatgatcgtaatcatctgtcccagagacatcgtcttatcgtcttccacgataatcttacgagccaaatgagtaatactccagaaaaggaataagatcgtcaggccgctaaagagggcggacatcgtattgaccattaccgccaccttggaagggtccgaggcgaactgcgtaaataaattggctgttaacatgaagaaaggagctccgggcggatgccctacttccaatttgtatgccgaagagataaactcaccacaatcccagaaactggcggtgggttccattgtcatcagataaacggtagaagcgatcaaaaaaacgacccaccccaacacgttgttgattagtttgtactttcccatactttgtataagtgtgataattaattgtttctacttgcatacccacacgggcagtcggccgcaaaggtaatcatttacgtttaatacctaacgttccattcccctataaattatatagaatagattagaattatattaaacaaaccttatcactcaagtgttaatagaatagttgagtattaaaattatagggagatgaaagaaaattatgaactaattgataatgaagaacgccaccaatatgaatttcatatagagcgatacgttcccagaatagagtatataaaaaataaggatggggtaatttatctcacccacactgaggttcccatggagcttggaggtaaaggaattggtagccaattggtggagaaagtgctcttggatatcgagaagaaagacttacgtctcgttccgttatgtccgttcgtagctggatatatccagaagcatccggattggaaacgcatcgtaatgagtggtatacatgtttaatatttataacaaaattatatgggcaagaagatcgaatatacgaatggtgaactcaccattatctggcaaccggagttatgtcaacatgccggtatctgtgtaaagactcttcccggtgtctataagccgaaggagagaccctggatacagatagagaacgcgacaaccgcggaattaattgcccaaatcaagcaatgtccgtctggcgcgttgacataccgaatgaataaagaggtgaaatgaggcccccccgcctgtctcatcttgatagaaaggagtattccgtatcggatactccttttttcgccataaggacctctttctatgattttttgctagttttgtgatctagattcactatcaatgaaacaaatatgataaaaagacattctatcttaacggcaatcctgctttgtttcgtcgctttcacacaagtgatggcacaagagatgcaggaacccgaaccgcttccgatcgacccaaaggttcgatacgggaaattgagtaacagattgacctactacatccgtcacaacgatcagcccaaagaccgggcagacttttacatcgcccaaaacgtaggctccatcttagaggaagagaatcaacgaggtttggctcacttcttggaacatatggctttcgacggcagtaggaacttcccgaataacgggatggacgaatatatcgagagtgtaggtatgcgcagcggggaaaacttcaacgcctatacctcctttgatgagaccgtctacatgattaccaacgcccctgtcaacaaaagcggcgtggttgattcttgcttattgatccttcacgattggtccgggttcctagccttgaccgactcggctatccagaaagaacgtggggtcatccgtgaggaatggcgtacccgacaggatgcccagactcgtctatgggagcagcaactacccaagatgtacccgggaagccgttacgcaaaccggatgccgatcggttcgatcgacgtgatcgagaacttcaagccggacgagttgcgggcttactacaaaaaatggtatcgtccggacttgcaagcgattatcgtcgtgggagacgtaaatgtagatcaagtggaggcaacgatcaaaaagatgttcgccgatgtccctgccccggtcaacccggcaaaacgggaacaagtatcggttcccgacaatgatctacctctgatctcgatcgccaaagacaaggaggcatccaatacgatcctttatatcttctataaacacgataaattacccaacgacttgaatcgtacgattgccggattggtaaaggactatatccagcaaatatgcgcgtcgatcatggacgagcgtttcgatgatatcttacatcaagcgaatcctccgtttatctatgcccaagcctacgacgatgataatttcatgatcgcgaagagcaagggagcatggaccgtagccgctcttgccaaggaaggcgagatcgattccacactgaccacgcttgtcaaagagacccaacgggtaaaacaatatggctttacgccatccgagtatgaacgggcacgcatcaacgtgttgaaacaatacgagtccgcttacaacgagcggaataaccaaaaaaacgacgcttatgttcgtgaatatgtgaatcatttcaccaacggcggttatatcccgggcattgagatggaatacacgctattgaaccagatcgcccagaatatcccggtagagcaagtcaaccaatatatccaagatatgatcggagaggataatatcgtgatcgggttaaccggaccggataaagaaggtataaaatatccgaccgaggagaacctgctccgtacattcctcaaagcacgacagatgccggtagagccttataaggaaactgtctccaacgagcctttagtcccgaccttgccgaccccgggccagatcacggagacaaagaccggccagcacttcggagcgacagtatttaccttaagcaatggtatcaaggtggtattgaagcctaccgaattcaagaaggacgagatcatcatgaccgctaccagcccgggaggaagcactttattcggcacgaaggatattgataacttaaaagttttcaatgacgtgatcgagatcggtggattgggtaatttctccgccacggatctaagtaagcgtctggccggaaagaaggtatcttgcgccctatcgctcagtcaagatagtgagaacgtgaacggaatggccgctccttccgatttgcgaaccttattcgagttaatttaccttagcttcacggctccccgcatggacgaggaggcctacgcatctttcgagacacggacaaaagcgcaattgcagaatatggagttaaatcccatggtcgctttcagcgactctttgtctaaagcggtttacggagataatcctcgtgcgtcacgtcttcgtccacaagatttcgaacatatcagttatcctcgtatcatggagatgcgcaaggaacgcttctcggatgcttccggtttcgtattcacgtttgtaggtaatatccagatcgatagtatccgtccgtatatagagcagtatttagcgacattgccatctcaaggaaaaattgagaagggaaatccggcggaggttccatcgatgcgtaagggagactatatgaatcgattcaaccgctccatggaaatcccgaaagtaacggtagccaacctctataccggacaaatggagtacaatctggagaatatcatcaccgctaccgcattgaaacaagttatggacttggtatattacgagaaggtacgcgagaaagaaggaggaacgtatggcgtcggtgtatccgctagaatctcacctttcccggaaggaagaacgacattacagatattcttcgatacggacccggctaagtgggagcagatgaacacaattgtccgcaatgagttgaaacggctttccgaggtaggccctcgtcaagaagatttcaagaaaacacaggataacctgctgaaacgtcatgcggaagtcttgcaggagaacagctattggttgaacgtattggatgattattattataaaggatttgataccgatacggattatgagtcgattgttaaggcgctgactcccgagaagataaaggcattcgcccaaaagcttttgggacagggtaaccgggtagaagttatcatgcaaccctagttactattttgaggggatgagacggggcgtgccccgtctctactttgatttctttagtttaaaatgatcgaatccttccccataaaccccgattacggcgctttgggatacaaaggcggtcggatcaatatcattaatgatacggaaaatcgtagtggattgccgttttttagcgagcacgaacatcatcttctgttcttgccccgtatataacccggtagcatcgatcaccgtaacccctcggtgcaacgcattaatctccttaccaatctcttgatacttcttcgagatgataaagaattgcacggactggcgggcactgttcacgatctgatccagcacgaaactacaaacatataacgttacgaaaccatataccactttctcccaatcctttagcacgaaataactggaggtgataataatcatatcgcagatcatcatgacccgtcccagcgttatatcccggtatttattgatgatagcggcaataatatccgttccacccgtactaccgttcgaggagaaagcgataccgataccacttccgcagaaggaggctcccagcacacatgccataaacggttgatcttgtaataaatgcatcccggctgtcagctcctggataagggacaagaaaaaagtaagcgtaaacacggcgaagatcgtcttgatactgaacttaaaacctaatattttcaaggcaagcatcagcaagacggcattaatgaggaagtaagtgtactgaacgggaaatcccgtagcccagaaaacaatggaagcgatacccggcactccacctgtcgtaatgtcattcggcaaaaggaaaacggtccatccgataccgtaaaggatcatcccaagagcgatcattaaatagtcccgtgtctcccgaagcaggacttgtctggataaggaagaaattgataaagtagatttcatctcatttgtttatttttagcgggcgcaaaggtaatgaaagttattgataggaaatgcttcaccttatatttagccggaaatataatggttcactttcccctatttacagagacgtaagcaaaagccaaggaatgttaactatttatcagtaataaccccttttatataacatcacctttatttagaaaagctctataaacgagaacatgaaggagaaagcaggcatttatacgccttttccacacaaaaagacccgtttttcgataagaataccctcgttagattacacatatagtcccgttcacccacgcctgtacaggcgtaaacccacacatatagtcacgataggctacacatatggtcataatgggcgatatgactaccttataatgggcattgttgccccctaacgactgggccataaggcataagatatgagataggatgaatttatttcgctagaataaaaggccgtttttcaacaagtcactagcggatagacgattgctgtttttttctttcgtttttaggagcgagacgtactttggcccgaaataatcgattctcaaggacttcagtttacaaattgtcacattgatattctaaccagaacacgcataagccctttcatccaattgtagagacggggcgtgccccgtctctacaaccaagtatgtatgagctgcaaatatagacttacaatctcacattctccatttcctcacacttctcttcccgcaagcgttgaatatccttaagctggcggtcgaaaaacatgagcaagtcattgatgagccgtccgttctgggataaaagcaaaaccccatccatcaattgcgttgacaggtagcgaactttcatattacttacatgttgatcgggacgctgcagataaacggccatacatctgtacaaaattggtgctatttgtatccacggcagttttaggcctaccaacagatttttcacgctttgtaactgatggttcagataatcgaaatcatccgcatctctctcaaaacagaaagcttctttcaagcgtcgtgcctcttccttaaaaaatacatcactcaacatttccatgttcgaaaccggagcgtcttgctctgaaccgacaggttcagttacgggataaatgttttccacttccataatatattagcattaagcaggcggaaaaaagaacggtcccgcctgacccgttgctaaacactttaccagaaagctggaggcacattaatgcactccacgggggtacggaaccgtcatatcggatcggttacaggcaaaaaaatgcctgcaaccgaatagaagcaggtattctactctgctttctggttttaaaatgtttagcattgcaaatatacttctttttccggatatccaacctatagaggataaataatgtctagtaagtaaaaaatccggagctgatacctataccctagaagagaaaagtttctctcgtctatttaaattcttgatggggctaggcaagcatgaaaaataagatctgtactatacgggaattcaacgctaaatctacgattaaagaacagatagaaagtctttaggggtcaatactgttatagttgaatttacaaaccctttcacatcccgcgtaataatataatccgcccccgacatttttgcggagtagtattgaacggcatcctccaaatccgagctattggaatacaaagcattcataaatattccatcgtctatcgttgatatctcaacataaccgcatatacgcttcaagacctcaagaagttcatcccaagaataaccgtatttatgagccgtataattcgcattgattaaggtgagagcactcatgacaatctttagtttatcctctatacaatatctaaagatagtatcagcatcctctttgaagccttcccgctgacatatcatgtctagcaacacattggtatctacaaacactctcatccgatttgttccctttaaatgaattttgcggatgctattgctccttttcccatatcatcagcaggcacttctttatgtggccccttcaaatggaagctgtctataattaagtcagtcgaaaacacatcgttttccccatcttttgcccgtataagctcccgggtcaacattgtttctaaccacttactcaaagcctttccttccaatctcatcttgttactatatctatgtaacaaagagtcatctatatttaaagtgattgttgccatatatattttttcaagttattgtagcaaagataattattttcccattctatccgcacatttctccttaaaaacacgattatttcgatacacggggaaatcaccaattatgcataagaaggattaagtatgcgttgagactataaatagagccccctcacgctatactatcatggaaattgcggaggaggccgtttcagtctaaagaatcttataacttgacagaaatttgttcacctttgtactcaattacctttgcaggcttacccttattatcccatcccgcaggagcattcgggcttacgtaaataatattgaaagttctctctgataacatcccgggataagagccttcacgactaccgattgtcaaagtattcgtcgcatcgctataattaaaatcgatcttcgaataagttcctttctggtaattattgttcgtaccttcatcttcatatagatagaaggagccatcctttccggcataaatatagacatctatcacttccggttttttctcatttacataagtgatctccggaccatataataagataccacctgacggagcaaatatcggcatacgttcgaatggagcctcaacctcctgcttttggccacctttataacgtttacccgtatatagatcataccaatccgttcctttcgggaaatacacctcacgggaagtcgctttataggtatataccggggcgatcatcatagaggggccgaacatatattgggtagaattatcccggacagccaagtcggaggcataatccatcaccaatggacgcataatcgtataatcatcaaaatacgtcttacctgccaacgaataaatataaggcatcaagcggtaacgcaattgattataatacaagatcgtctgataggccggatgatcttctggggcgatattataaatctcacgcaatggaaactgtccatgcgcacggtacaaaggggtaaatgtgccaaactgataccaacgggcattcagttcccgccattccttcaagtcgtcattctcaacaccggtcttgtcataaataagctgtcctgtacgataacggttctccacgcagaagccaccgatatccattgtccaataaggtataccggagattgagaagttcaaccccgcagaaatctgagctttcaattcctcccaacgagtaccgatatctccgctccaagaagcggtggaatacctttgtaggccagcgaatccggaacgagtcaacaaaaatacgcgatcatccggattttccttcaattgcccctcataaatagcctgcgcattcaccaacgcatacgtattataatattgagctgaagggcctaaagctgtcgggccggtcaacgccttttggtaagacatcggtgtacaatccttaatattcggttcggaagcgtccatccaccaagcgtccactcccaaacgatataggttatcattcatttgtttccagaataacttacgggcaccgggggcataagcatcataaaatgtagccacgaatccaggtggaacaaaatcaaggatgctatccttaaccgcttgcaggtaaacccatccgttagctgccaattctttataattctttgtggtaggataaaatttcggccaaacagagatcatgaaacgggcattcaaatcatgaatcgcatcaaccatacctttcggatcagagaaacgtgccggatcaaactcatggcttccccatgaatcagttttccagtactgccagtccatgacaatattatccacacccattttacgttttcggagctcacgcaaggccgtcaatatctcatcttgcgttttataccgttcacggctttgccaaaagcccatcgcccaagcaggcatgatcggcgatttaccggtgacataccgataacctgagattacctcgtccatcgaatcaccatgaataaaataataatctatatcatttcccatctccgaccacatagacaatcgccctacttcttcttccggacgaggagacaatactttcaacccaatataagagccggctccctcacgccattcgatacgcaccgggactttctttcccgcttgcaaatcggccgtgaatttcacgctattaggattccaagagggccgccaacgttcttctaccaccagtttattatccaagaagactttcgtatacgctccatagaataacttaaaatgataaacaccactttctttcggttcgatctcaccttcccaaacgaccaagctgttcctgaaacggaatccttccgggaatttatcaaacgtctctcccttaaaatcaaacgtcttcggaagaggttggtgcgtaaacagggtctcgtaatcaattctggactcttgacgttccgcaaagacctccaatccattatttttataataagtagcggtcaaacctccctctttcccattcttatcgtacaacttaaagatatccaagttcgaataagggcgtggatcaccgtaccgggaataagaatagttatcgaataagacaccataattcttggaagaaaccacgaaaggcaccgatatcttggtattatactgatacaactcctcatttttcgatttataattaaattcatccgactggtgctgccccaatccatagaaagcctcgtcttccggtgaattaaattgctggcgagtcgtatagcctttgcgaccttctacctctatcggcgtaaactgccgtccaccgttactttctcgcaatattagcttacccgacatatcatagaatgtcacttctcccgtaacaagactgacggccgcacgtaatttgccggtattcagaaatacggaatccgaagtcgattcgacattccattttaccggggcctttaccggagcgacacggactaagctctgcttatcctgaatcttagcctccgggcttgccgtcacttgaagaacctcatcattcacaaccaacaaacgaaccgttttcgattggttcagctcgccttccggcaagctgaccaatataccattcgctatctttttatatccggcctgcgccgagaatggtaagacagccaatagcccatataacaataaatacttacatctcatatcctctaaatttaaagaattaataacccggattttgtgttaatttcgtatttaactcaagcacagaagtagggatcgggaaaacggttgtaaaaccggtattatccactacgtaatcgccagtggcgacattatgatgcactcccgcataacgatcagtcgtaggttccgtataagtcccgaaacgtatttgatcctgacggcgcatcccctcataagagaattccaacatgcgttcatccaagatatcttgcaaagtcacgttacttttctgtccggcttgtacacggtcacgaatctcattcacttccgcatcaccgctttgtcccatacggactttcgcctcagccgccaataacaaggcatctgcatacctccagaacaccttatcattattatgattcaaataagaagaagtcgtattatccacctcatatttagacatacgggctcccgcaaattttaatatctggttcggtacatcctccttaaaatcaacaaccacatccattgggttatagcataactgagctccatcgcctaaacccgcatctatcggcttgccatccacgaacaccggtccataaaagaacgtcatatccatacggggatcttgttcatccgtaccgtacttgaaaactttcatctgttctacggtagcgcaggcaccattccaaccttgcaagccataagcggatgcgtgggccgcatataatgtacgagtcggattataatcgctcactttataggtagtaccatcactcggttgagtccagatattttctaccgaactatcgtttgtcttggaaaaattctgggagaagttgggttgtagactatatccctccttctctatctgtttctgacaataaagaaccgtctcccaagcgtcacgagtcgtaccatccaacgcgatcttaatatttttgcccgcttggtttacatacggcgcaactttagcgataccacccaccaaagaaccatcattccaatcatcttttgacaagataggactattaatagcgactttcgccatcgccatataccccacagccttggtcacccggccataatacttgcccatattctggcattttccactgggcaaatggggaatgcaatccgtcaactcatccacaataaactgatagacctcgcttctcgaagattgattcacatccgccatcacagtcttcgaagaagtaaccagaggtacacgaccgaataaatcgaccaaatgataatacagaatcgcacgcacggcacgagcctcatattgataatcttgcagatagctctccccacccgcttgaatgaaggtctccagattatcgatcgaggtattacagttaccgataatcgtatatagcgcattccaagtactctttatcgtagcgttacccggaccataattatgcaaaaacaaggattgccatttacctccatctacccagtcgccttgtcttcccggcaatatccaagcatcggaagaaaactcttgtaaagtatgcacattatccgtacttccatataaccgattcccaaatgaggtataaatcgtagcgatcgtatttacatacaccaatttctcacttttataagcttcttcttccggtatcttactcttgggatcctcatccaaaaatccggaacaagcggagaataaaccacctaaaatcagcatggagctcaccaatacttttttcatgacaatacgtattaaaagattaacaattagaatttaacacccagtgagagtgaataagtacggctcaacggataaatcaatttatcatccacacccaacgtacccgaaacagaagatttagacgccacattcgccgagttgataagcggcgtcataccagaataacctgtgatggtcgcgacattgttaacagagaacgccaaacgcaaggattttaaatacttctcaatcttcagtttcttgacgggaatattataacctaacgtaatatactcgatattaacatagttaccattttccagataataatcagaaatcttgatgtcgtatatccgcttatccaacgccccatccaatatattataggttggatacaatgataaattattaaacgtcaaacttgtaccattatagattttatgcccgaacgccccatttaattgaaccgccagatcaaaatctttatatcgcatattaacaaagccacccatatatacctttggtaacgcttgacccgctatataacggtcaccgctatccgataagtccactttgccatcgccatccagatccgcgatatcataaacaaacttaccatcttccttctctaccaatccgttgcaatgaggaatatagaatacgcctaagggttgtccctccgtcaagtaagtaacacccgcatactgggttaagctaggagcgttcaccgccgatacttggatatatttactagtcgtaaactctgaccccatatatgtaccacttaatgatttaagcttattcttctggaaagacagattcgtacccacggttaatgagaaatcttttttcttgatgatatcgccgctgatcgctacctcaaagccgttattggtcatttctcctaagttcgcaagcatagacgtatatacgaacggaggaaccggaacggtataagtgtacaacatatctttcgtagtagacgcataataatccattgtcaagcgaagacgggattggaacatcgctaaatccacgcccacatcaaacgtatacttcttttcccaacgcaaatccggatttggatttgaatcgatatagaaagtagtcgtagccgatccatccaccaaggtcgttccattcggagccatcaaggagagggattgatacggatcgatcgcatcttgattaccggtcacgccatatccggctctcactttcaagttatcgataaaagtcaaggacttcataaaagcctcgttcgaggcgatccaagcgacagaagccgacgggaagaatccccatttattaccataacctaatttagaagaaccgtcgcgacggacattcgccgtaactacgtaacggctatcatacatataattaaagcgtgccatataagataataaagcgaaacgggtagcattagaggtagcgtcaccccaacttatgttagcaccggctttcaagttattataggtaaaataattcgtctcgtaaccgctggttttcgtggaagactcgaacaaagactgtgtctgcgcctccaataaagccaaagcgttaatgctatgccgtccgaattcccttgcgtaattcaattggagatttcccatcaagtcatttcgttccgcatatttcaaataggcctgtccattcccgttcatcgaaccctgttggatatcattcgggatataacgccggtcattcaagctatagtaagtatacgaaccgaatcccgtcaagttcaatcccttgatgatctccacgtttacacgtccgttcacgttcacatgagaggctattttcttatttgtgatctccaacatacctaaggggttatatacctcgatcgcggtcttatcctcatcccagatacccgtttccggattcttatagttcggatacgtaggattgtaagctgccgccgaataaatcgtacggtacatatcaaattgatgatcgccttccctacgtgatccaaacatgcctaaatcaaacttcacccgtttctggaaagcatactggcttgcgtccactttggccgtataactattggaagaagaattcttcaacaaacccggacggcggatcacaccgagagaggcccttagattggaattatcattaccgctcgtaaatgagagattatgggtctgggtaagactggcagaacgttccacctcctcaaaccaattcgtactcgctcccatatcattcgtactcaatcccatagccaccgcaccggcacgccattcatcggccgttaacattcccaagttcttataaaccttattaacaccgaataaaccattatattcaatttgagcgaaaccggctctacccttggcagtcgtaacgacaattaccccggacgcaccccgtgaaccatactgagccgtctccgaagcatctttcaagatagtcaaagactctatatcggaaggagagatggcgttcaacatacttaaatctccaaataccccatcgatgataaccaacggatcattgcctccggatagagaggtagtaccccggatacggatattcatatcactcgtagggtctccacctacattactgataacaacaccagcgaccttaccctttaccgcatccaaaggctccgtaacgacacccgagttcatatcctctttctttactttctccacagcaccagatacggaacgcttgtttcctatggcgtaacccacaacaacaacatcatccagcctttgaacgtcttcatccaatgcaacattaaccaccgaaagattccctatactcaccttcttacttacatagccaatataagagaagactaatgccgcttttccattttgtacttccagcacataattcccgttaaagtcggttatcgtcccgttttgggtaccttcctccagcacgctgacaccgatcatcggttctccttgggcatcttttacaaccccgctaattttcttattttgttgctttattaccgcatggatctctttgttcgccttcgctttgtagattataatatgctcatcttttatctcatacgtcaatccctgttttctcagaaccttattcaagacattctcgagtggctctttgctgacatcaacagacaaaacctctttcaaattgacttcactacttttatagataatagaataaccagattgtttttccaactcacggaacacttgttctaaagtagtctgattcagagataaatcaagaacaaccggagactctgtggcagctaatatattactcgtatttagtattaaaaataacatgccgattgccataacacgaactataaagtatggaacaccatactttacacgaattcctgtgtctttcttcatgatagataaatttaaatattaacaataactagaggtcatttcaaatagcttggctcctacactcttttccagatttcacttcataggcaaatgaatttaagtattaaacgttcttgactagcttgatttttccatccttctgaatatatgtccatgagcgttggtaagataactttttaagaatatcatccaaactcacgtgtttccggaaacttgcgacatatttatcatactttatcgactcggagtctatctcgatcctcacgttgaaccgcctttccaatatggtagagatttctgccaacgtctgatccttaaacaccagaataccgtccttccagcacgtataatcttccgcatccacctcatggcaatagagtttacctgtatggctatctttaattacctgctgattaggagataatatcatattctccttgccatgatccgtcaatacttgcacggaacctctttccaaggtcaacacggcttggcgatcagtatcataagccttgaaactaaaacgggtacccaatactttcgccgagaattgcttcgtatgtacgatgaacgggctctccatcttcttcctgacatcaaagaatccttcaccctgtaagcacacttcacggttatcggaaaattcggccggatatgtcaagctagatcctccattcaacgtaacttgagtaccatcagaaagggtgagatgcgtgatagcaccctccggaacttccacgacaataggcgcttgagccgttaagagctgccgactattgatgattccgatagaaacgattacagaagaaagaatcaagattgcgatagaagcggccaccggccaataacggaatagacgggttcttctagttgccatcagattataacgacgtcccaacttctcttccacccgtttgaaaacagcctcttttccctcctccgcttcttgaacggataaagtgtgtttcgcttttatcgcatttaaaagctgtaaaatcagctttatctctttttcttgattcttttgattatccacaatcatacactttttacttgtaggagccacctacatttgattaatgattctataaataaagagtatggaagtcttttttacctataaagggtatcacgagtttaacattcattaaaacaacagatgaattctccttttaacgacattgtaatatcggctcaccgcatccaacattttccggattgcgatattcatttgttgctccacggttccttccgttattgacaaggcttgagcgatctctttatgcttcattcgctcttcacgagccaataagaagattaatttgcagcgttcggggagttcggaaagggctttattatatacctctgtcatctcggcgtcaagcagatcactatctacctcattcgtatctatatacaaatctatcggtagctcatcaatggatatgttttggcgttgatgctctttctgtttcaagtaatggaaagattcgtttctactgatgataaataaccaagcgttcaggtcttctatatcaatcaattcttcccttcttttccataggatacagaatacctcggatacgacttcctcacgatcttccttatttggcagaaaatatcccacaaaacgattgaccgtggcatattgtatgtcaaacaactcacgaaaagaggcataatctcctttcgcgacacgagacagtagagtttttaatatgaattcgtttttcattacgattagtcaaatccattgtctttcataacagatggactcatctctctccttttgtggcaaaagtaataaaaaacttataaacaaaaagccttatcaaatatttagcttcttcttaataagagggaagcacttatatatgataaggcctataaaagatacaagacttactaactataagctatgctggaacatccaagccagataatccggttcggcgaaagcgttatcccaactgttatggtctacaccgggaaattccttataacggacatcagctcctgctttcttcaatgcctcattagcgtcacgggagaattgtacatcgactacgctatcggagccgccatgataaatactgaaagccgtcttgcccttaaagtttgccaaacgttgcaaattcgctccaccacagatcggggtggcagcggcaaacaggttcgggtaacgcatcacgatatcgaacgtgcccatacctcccatcgataggccggttacgtaaatgcgtttcgtatcgaccttaccttccgctatataactatccaataattccttgactgcggccattgattgcgtggccggggcattcaacggataaaaacgcttcccttcttttccggcgttcaatcccttatattcagaccaagtcttctctgccgggcattgaggcgctatgatgatagccggatatttggtttgattctcgaaagaagcgaacatatcgccaccatgtactaattgggcctcattatccgaccctcgttcgcccgctccgtgcaggaacaggattactgggtatttctgcgccggattataatctcggggatacagaacccgataattcaattgataaccatcacgagccgtaaactgctttttcaaaaaactagccttatcaccagcatatccagcaatggagagaagaaggcaaagagacaaaaaaaagatacttctaagtgttttcatacaacattatatttaagttattaataaatcacacattattatttagttgtagagacggggcgtgccccgtctcatcccagtaaaacagtaactttaagataccatcagacggtggaagacggggcacgccccgtctctacaactaaggagattatatatagaaacaatcacttgcccagtttaggggattgttttcaatgtaatctgctatacgattcatttcagcatgatcacgaataatgtgatcatggaaacgtggttgccatgcaaaaatacgattattttgatgtgcatataccgtgacagcagatttaatgcctccaatccctatcgacagcaatcctttattccccaatggtactaacgcctcatctcccgccacaaagaccacggcatgtacatgattaggcatcacaacaaatagagggatttcaaggtatggataatggttatttgcatgctctaaattatcatgagtgaagtgacctaatggattcagcgacatttgcccgccaagtacacaaccaaaataacattgtttatgtgctgtacagatcgtgataaaataaatacctccattgtaatcgtgccaagtggcacgggcagattcgatacggaaacgattttgatataggtttgccatagttatgtgtcttagttaattgttctttataggtacaaatatagcatatattctgaagcgaaagaatataataaaaaatatctagttgtagagacggggtgtgccccgtctctttccaacaaaatggtattctaaattactatcagcctgtgtaagacggggcacgccccgtctctacaactggatgattggttttgtcgcttctgatacaccgttctcgttgaatgcctcgatggtgaaataataaggctggtcggtggacagactctttaatagtaattcattctttccgtataggagccatgaattgtatagtttatcgggagcgataccccaacggatgttgtagccttggctgttcttggctgcgtcccaagtaatcatcgcgtcacggcggtccgcttggcgaacgaccttgaagttcttcaccgtcgcaggcttcttgccctcaccgataccgaacacacgcaagtccgagatcgccagatgaggcgtcgggacctctatattcttataacggacataacggacacgagccggattatccacttgtacgtaatcattcgggacatccttataattattccggcgatccaccaacgttacccaatcctgcccgtccaaagagccttccaccgcataacggtggcgtaaaccgggaatacgtccatacatattcgattgatgatcgtgataattcacttgcacggcatataccatagcgggagcctccagatcgatctctacccattcggtatctccattcgtgcgagccatccagaatgtcttacattcctcatccgtcaagttggccggaaggaaattggcggaggtcttgggacggttcgattccgtgaatccttgcgcggcgggagcggaaccctccgcatacgaggaagctttcaccggctttttataagaaagcaacatccaccccgtaaactctcctttctttcccggctcggcgggagcgtaatgcggataatcaccgaagttattatcacaatacataatgccctccttatcgaagaaagtaggatacatgcagaggcgacgctcccaattcaccgtagccgagagagacatagaggcgaaatgccaataattacctcccggccccaccaaggtacttccgtgtccggcaccattcatgaaaccaccgggcttatagcttaccgggttatgcgattgatacttatacggacctaatggggagtccgccacataaacaccatcggcatatacgttgaattccgtaccgggggcggcatactgcatataatatttaccgtcgtgcttggtcagccaagccccttccatatagcctcccaataccgtatcggtatggttctcgccaaaacgttcccagccatgcttcggcatatccaagccgaaaagctcgaccgtctcaccctcgatcaagaaacggtcatccttattcagtttcttgccccgaagcggataaacattggaagagccccagaataaataagcttgcccgtcatcatcgatgaataaatccgggtcttgtaggtcgtggagtatagcaggagtagcgttccaattaccggatttcggatcatcggtataaagaacgctcatggagccggacggatcacccatcacataaagcacggaatccttataattatgagcggcgggagcgttggaaccctgaggataccagtttttaccgggagtgataaaatcccagttcaataagtctgtcgaatgccagtagccatgcgagcgggttacgaacatataatactcgccccggaactccaccacggcgggatcggcccccgaacggtacgacaggttgttcgacgagttataaatcatatacgtataatccacattaagcggattacaatacgtattcgcccgcatggattgagcggtggcggaacctccggaagcagccaagaacagagccgaaaagatatattttgataatagtttcatgttgatatgtattaatttttaccgcagagagaaagaagactgattcgcctcgtcggcagaattcaagcctacccaaaccgtgaaatcacccggctcggctttcttctgcatatcgataccatagaaagccagcaaagcttcgtcaatcgtgaaagagacttgcttcttctcgcccgctttcaaagtcaccttctcgaaacctttcagctctttaaccggacgggtcacgctacccgccaagtcgcggatatacatctggatgaccgtctcgccatccaccttacccgtattctctacctcagccgttaccgtgatcttaccccctttcgtgaaagagttctgatccagcttcatagagttcacggcgaaagtcgtatagctcaagccataaccgaacggatacaacggtgtgttaggcacatccatatatctggatttataatccgtatccggagcttccggaggaaccgggcggcctgtcggtttctgattgtaatacagaggcaattgacctaccgtacgagggaaagacatcgtcaagcgagcggacggattataatcgccactgatcacatcagccataccatgacccgccatcgttcccagataccaagcctccaagataccgtcgacatgctgatcctcccaagaaagatccaaaggacgtccgttcaccaagatcaaacctagaggtttacccgtctttttcaattctttcaacaaggcttgttgagcgcccggcaatttcaagtccgtacggcaagcggcctcaccactccagttgaaatcctcgcccatagccgccaatacgatatccgcacggcgagccgtagcgatcgcctcagcgaatttagatgaatcatcagtcaagagatcacatccctcggcataaatgaacttcacgttcgtaccggcatatttctcggtcaggccctcgaacaaagagatactctcctcacgctcaccccggccggcccactcgccattctggttgatcttatcttttaccatcgggccgatcaaggctaccgtaatatgcttatccttcgagatcggaaagaagttattatcattcttcaaaaggacgatcgagcgagcggaagtctcacgagcctcttgcaagaactccggcttcatgatcgtattcttctcacgctcattgtccaagtaacgatacggatcatcgaacaagcccaagaggaacttcatctccaagatgctcgccacggcacggtcgatattctcttccgagactttaccctctttcacggattgtacaagatattggctgtagatgccacccgtcatatccatatcgataccggcgttcgcagccagttccccagcctccttgtcatttcgcacgatactatgggctaccatctcattgataccggtataatcggtaaccacgaaaccattgaagccccagtcctcacgtaacaaatcggtcatcaaccatttattacccgtgctgggcactccgttgatctcattgaaggaggccatgaacgtagcgactcccgcttccttagccgctaaataaggcggcatataataattcatcaatgtattttgcgacaactcggacgtattataatcacgtccggcctcagcggccccataagcggcaaagtgcttgcaacaagccaagaccgtattcacgtcggccaacgaacgccaatcgtttcctccttggaaaccctcgacacgggccttcgcgatcaagcttcccaaatacgggtcctcaccggcaccttccattacacgtccccaacgggcatcccgggagatatccaccatcggggcgaacgtccaagcgataccggaagcgctcgcctcatccgccgcgatcgccgcgcttttacgcatccgctccaaatcccaagagcaggattccgccaacggcatcgggaaaatcgtacgatagccgtgcacgacatcataaccaaacaatacgggtatcttcaaacggctctcggacagagccatctcttgcattttacgtacgccatctaccgtatatacattaaacaagcttcctacaagaccttgtttcagcaaagtctcataatcccccgtcataaccgggccggttacatcccagttacaggagtattgggccatctgccccaccttttcctccaaggtcattaattggagcacagaatctacacggcgttcaatatttttgtcgccgctgaagcttttccagccacttacagcgggttgctggcatccacctaaggtagcggcaacggccgcaccagcgataaaagtcgttaaccttttcattattcgtatctgtattatttgttccaagttacctgcgccgatttcacgtcccgggagttcgtacctacgtaaatattgaataagcccggttcccagatgtattccaacgcgctgttataaaatttcaagtcttccggcgtaatcgtaaaagagacttttcggctctcacccggtttcaaggagatcttctggaagttcttcaactctttcatcggacgggagatgctggcagccggatcgccgatatataactgtacgacttcctcgccctctagcttgcccgtattcgtcacctgtacgctggcggtcaatacaccgttctctccttgcacactcgtcttatccagctgaagatcaccgtaagagaaagtcgtataactcaagccatagccaaacggatacaaaggatcgttcgtgatatccagatatttagaagtgaaatgatcatccggattcattgggcggcctgttttcttagcattgtaatacaaaggaatctggcctacgctacgagggaatgtagtcgtcaatttaccggaaggattcacgtcgccgaacaatacgtccaccaatccgcgagccgcggcggaacctccatgccaagcctcaacgatcgcggagaattggctatcctcccactccaaggtcaacggacggccgttcgccaagaccaatactaccggtttaccggtctccagcaaagctctcaacagctctttctggctctccggcaaactaatatccgcacggctgcaagcctctccggaccagttattcggctcacccactacggcaatgatacgatccgcatctttcactttctcaaccgcttccttcaccaaacgggtattctccaccggatcaaccttcaagccactggctttcgccaacatcggctcgttcgtcaaattacatcccttggcgaagatcacacgggccttattgccaaccatttctttcacagcctgcactacggaagccgacttcgccgtatcgataccacaccatgtcccgaacaactcaaccttcttatccgccaacgggcctaccacggcgatcgtccctgtctttcgcaaaggcaacaaacccttgtcattcttcaacaagacaatggatttgccggcgatatggcgagccgtattcatatgctcatccgtgaacgtattctttttcgcacgatccgcgtccaagtagcgataagggtcctcgaacaaacctaatttatatttcgcctccaatacacggcggcaagcctgatcgatatccgcttgagacacacggccctcttccaacgacttcttcaaggtcgtgatataaccatttgtcatcatatccatatccaagccggcatgcaaagccaaggccgatacggtctgcgtatcacccaaaccatgattagtcatctcgccgatcgaattataatcggaaacgacaaacccattgaatccccattgatcacgaagcaaatcggtcaataaccagcggttacccgtagccggaatcgcctccaccaaattaaaggaagacatgaccgtggcacaaccagcctctacagccgctttataaggcgggaaatactcattaaacatcttgatacggctcatatccaccgtattataatcacgaccggcctcggaagcgccatacaaggcaaagtgctttaagcaagacaagatcgtgttctctttcgtcaagtcatctccttgatagcctctcaccatggcggcggcgatctttccaccccaccaagggtcctctccactaccctcggcgatacgtccccaacgagcgtcacgggcgatatccaccatcggggaatacgtccatgtcacaccgtttgagctggcctcgatagcggcgatacgggcactttgctcgatcaacgtcgtatcccagctacaagacaaagccaacgggatcgggaagatcgtatgatatccatgaatcacatccagtccgaacaaaagcggaattcctaagcgagattccttaaccgctatctcctgcaatttacggaacgtctccagctccgagcctcccgtagcacccagccagccccgacgaatcgtctcgtccgcaccttccgagccactcaagatgccgggaacaccaccaccggacaagttcagctgtccgatcttctcatccaaagtcattttacccatcaactgatcgataaacgtatccatcgctctcgtatcttgaacgggcttttgtccgtatgccgcaagtgccaaacaagcggcgaatgataatataatctttctcatgttatttaaatattaagattctctcgcattatggatcgtgaaacccaatttcttcaaaccgtcctggatttccggacagctcataaacaaacgccacagaaggcccgtacggtaattctcgatcatcggtgcgatcgtacattggtctatcgccagataacgatgcggataccaattctcgccttcactgaaagcgtcgtaaaaaccatacttaccccagatgctatctcccagattgaaatagaaatgcttcaatgccttcgaggattcctccggtgtatacggataactgctcaaggtggctgtcggcgtaattaccccatgatcgttggagggcatatgcgcgttatagcctttcacggaatagctggcggtcaatccccagcaagcgtcgctatatcccttgaaacccttcggattctccgcgcaataacggtaatcgatcaagacgtgattccggttcaagtcccagtagttagcgtatcgatccgacaagcctaccggacataggccgatataagaataatgcgcccaaaacaacgggccgccgtactcctcggcataattatgtttcaagatcaaaggtaaatcgtaagcgaccgcatcgctcttgatcccccctttacgagcccatccgttatgataagcggaagccgggatcggatacgtaggcgaagacgccgccagaatataagtgatcaagcattcattataaccttccaaaggaaaattcatctcccatgcgtaatccgggctccaatgccaatacaatacatcctgcccgttcaaataccaggtccattccatctcacgccatagctggtcaatcttcgcagccaacgctttctcgctctcattaccatccttgaaatattggcgtacgcataagagaccttgcattaagaaagcgctctctaccaaatcgcctccgttatccttctggccgaaaggctttaccttacccgtaggtccatgcatccagtgaggccagaccccgtggaaacgatcggccttcgccaagtaatcagcgatttgatgaaaacgggccacaccttcctcacgggtgataaagccacgctcaatacctaccaacagcccggcgataccaaaaccactacctccggtggtcacgatatcagcgtcgttctcaggatacacgccatccgtatggatacgctcacaggccagtccggaggtaggctccgcaccttcccacatataattaaagtgagccttttgtatataggtcaagaattcatcatccgactgaaaatccaacttacgctcattgggcgtagactctgcggatgtgtcacttttcttggcctcatgacaagcggtcaacgaaaagccaagcaacagggtaacaacgcctgtacggaaataggtattcatagatatatacatttaaaatagttatcgtctcaatactttactcatcggtgaacggccgctctctcccaatgcctcgatcgagaaataatagtccgtatccttatccaagcccctgaaatcgtacatcgtatctcccagtaccgtgatactgttgtacaatttatccggcgttataccataatagatattgtaagcgtacgcctcttttaccggctcccaagtgatcagcgcattccgcttatccgcttttgagcgttccacctttaaattcttaacggcggcgggagcttctcccaaaccatttccaaaaatacgaaatccggacatagcgaagttgcccgaaggcacatgttcgttcactattttcaaataacgggttttcaaaggctcacgcaactcgatatagtcgtgcggaacgtccttgtcgttatcgctcttatcgactaccaattcccaattttgtccatctatagaatgataaatacgatattgatgatacaagtccatcgccttattatgctgtacggctctatgctcgtaatagttcaactggatcgcacgtacctctttcaatccctctaaagagatctggagccattcacccggctctcccgagcgggcggaccagaaagtacgcatgctctcatccgttacattctctggtactaacgtactatccatggaagaggccatcaccggttttccatacgatagcaacatccagccggaaaacgtattcgcgatatcatctaccttccctttcggcgtaagcaaaggatagtccccgaaagcggtgttcgaatacatcacgccatccttatcaaatgccgtagggtacaaaccaatacgacgctcaaacttatatttcaaagaaagcatgcaagtagccacatgccagtaattgccatacgcatcctcgaaagtaccaccatgaccggcaccttgtacgaaacctcccggcttatagctcatcgggttatgtttctggtaggtgaacgggcccatcggcttgtcggatacatagacaccatccgcatagaccttgaactccgttcccggcgcaccgtattggaaataatatttaccgttatgcttggtcacgaaagctccttccgtaaaaggcgctaaagtcgtactatcgtcattgttcatcccgaaacgttcccatccgtgttcttccgggcgcagcatcatgatctcttggatcttgctgatcgggtggaaatcacggcgatccaattccactcccttcaaagcaaactcattacttgaaccatagtacatatacaaacgtccgtcatcatccagcaaaaatgccgggtcccagctaggaagagccgttttctccacataccgcttgaactttccgcttttcgggttcgtactataccaaataggcaatcccgcataggtagaaccggtatagaacaaggtatcttcacttacgaaagcggccggagcgcacaagtcgtcatcttccggataacgttggaaaccggcgaatacaaactcccaattgcttaaatccttggaataatagaatccggcttggttcgtggcgaaaaggaaatattcccctttatacatgaccatcatcggatcggccgtagagcggaaagagccattcttcaccaaatccggcagattcgcccggaagcagtagctcaaattcatcgggttgcaataggtagagggatgatcggccgtagcgtcgaaccagcgggtggcttgctgaggagcttttacccgtacatcacgaggatccgcttccatccggatatctattttcgtatcgttatcgccaaacgtgcgataagcgtacttcatccccggataatacacgaataactcatgatcgtagcggcttgcttgtatcttataatagcctgtcgcatcggtggtataatgaaccgggctagccgtgaacatcaccgtagcgccttccaagggcttgccgtccggtccggtaatcgtaccttccagaaaatgtttttgggatacggtaatatagtaatcgcttacctgccccttgatcacgatcacggaatctccccgctcgtttacttgagcgtttacggtagagaccgcgaagaaagaggcaaggagtgatacgagcatacacttattgtaggcttttaaggaagcgctagaaactcctacgtctttccggaaaaacatgtacgtgttttccgaaaaagacgtacatgtttccgagaaaacacgtacatgttttttccaagaagcgatagccctatttattctattacatgccagcatattatgttcaagataagttattgttgttttttgtcgcattattattttatggattgaatcttttggatacctttctggacatccggatggctcatgaaaaggttccacaacagattcgtacggtaattctcgatcataaccgttacaggcgcttgattcaatcccataaataagggagacacccaatttacagtcaagttgaaagcatcccggaaaccgtactcaccccataagaagctgccatggttacgataataattccgcaaggctttcatggaagcgtccggcgtataagggaaagaagccagagcgcccgtaggtgccatcgttccgttatccctgtgcggcatcggctcctgagcttgatagttccaagcgaaatcgctggcggtcaatccccaacaatcttctccataacctacataccccccttggttctcgatacaataccgttgattgatctttgccattttctggttgttctcgaaataattcgtatacttatccgtgaacttatgtgggtccagcccgagataggagtaatggataaagaaaagaggacctccattagagacacctacttgcaagttctccccataataagtattgccattcgtatacatcttaccatcttctacacgcccccaatcggcacggtattcttgcgcatactcctcttggctggcccagccgctataatacatctccggagagattccgtatttcggccccatgatagccaacatataggtaatcatggtctcattccagccgatcaatttatgattgatcacccacgcctgatctggagaccagtgccaatatagatatgggctgtccttaaattgcttataccagctccattccacgtttttccatagattatcgatgctcttacggatttgtttctccttgtcattctcttggttgaaatattgacgagccgttaacagcccttggaataagaaagaggtctccaccaaatcacctccattatctttcgggccgaagaaagcaaccgtcttcccggttgtcccatcgataaagtgagagaccgccccatggaatttatccgctttctccaagaaagaagtgattttcaagaaacgctgtacgccctcttcccgggtgataaatccccgttcgatacccgccacgatcgccatgataccgaagccggaagccccggtagcgatcatatcattccgtccgggaatattctcacgggcaagaccgctgtttggctccgctccctcccaatagtaacggaagttcgcttcctgtaccatatccagcaattgctcgtccgtcattggataggtagtggccgagactgtctgggaatcattggattcattcagcgcataatccacggccgtcaccttataataagcctttttaccaacctctcccaagaaatcggtataacgattcatccaagggcggcggacagcgaccggctggtaagtgatcccgtcgaaagaacggtaaatgcgatagtattttatatcctcctttgattgaggaatccatttgatatagatatgacgctcataagccttagcttcctgcaagaccggagcgtttaaggtacttaccgacggaagggaagccggcaaaagctctatatcgtccaaataaatcgtatattcgtttccatcggccgtaccgggacgaagggctacggccgctaatttcttgatgttcgtatcgttcacggcgtttaatccgaaatccttcaaaggaatggatacggaatgccatacgccgggacgtgtatctttcagataatttctcaggtttaggtattgggtatacgtgctgtccgcataacgaatagcgatattgggaagagcggcagcatccatgctctctctcagttgtacttgtaaagagagcgtagagggctcacgaaagaagtcattgccacggaccgggcaatattgtatctcgctataccaatctccaccgggagcggatacataggtaagctccaaggaattgccgggtgtaaaagcgacagagccggcaaccggaagatgatgtctcgcatttttaatccaagaaggtgaggtatatttcgcttgagaataaaagtaatcccctttcatcaagctattctcgaagaaaacatagtcgtaaggtttctccaccgcttgcaagctggcggataataagagagtagttagtaatgcgatgtgtttcatgatgttgatatttatataaataaacgatatgatttgagataaaataggcggtgccaaacgggttgacaccgccttgccaaactacaaaggtctagtaaataatgagaatcttatattactctgttacttccggctcaaaaggcacaggctcagcttctaagttaggattcaagtcaatttgatcctgtggtatcggataatattcgctttctcctttcacaaaacccggaagttcttgagtggctctgtccgtacggactaaatcgaagaaacgttcgccccattccaatgccaactcaacttgacgctcttccagaatttgatccaaagtcgcatttgcaatcggagctaaaccagcacgttcgcgaaccaagtttaatggagcgtctccattttgtcccttacgaactttagcctcagcgttcattaacaacacatcagcataacggaatacacggatattattattatcgccatatccagtacgtcccggagtcatttgattagccggtgtataagcctttccattataagcagtcggttcacccggttgagcgacaggaatataatcaccgtcacgagtagtggcatccgtcatgaggaacgttgtttccgcacgaaccgcttcaccacgtttagagaataaattacggattttctcagtcggctcaataaatgcccatccagagataggagcctctccacgaggaccttggaacgcaaaccagttgtcagaagaaacgatatcaccacttccatttccaaagtcagtaaattgatactctagcaaagactcattacacaattttcccggaatcttaaacaactcatagaaatcattatacaactcaaactttccgctattgacgatatcctcggtcaaggccaatacctcatcccattcattatcatacatcttctgtttcgctttcaacatctcagcggtatattttgtaaccgctcccggatgctcagactcattcggacgaatagccggtaagtttgctatacaataatccaactcgtcataaatgtacttctttacatcctctttcgtattcttgaatacattcagttcttgattgtctaacaaaagaggcacatcgccaaataaatttaccaactggaaataagcatatgctcggaaaaagcgaacttcagcagcatattgagcgtttaattgcttgtctgactcactcgtcaaatgtttagcataattctctaaagactccaatgctgaattagaagtagagacaacataatagcagtttccccaaaggccacttaatgcccagaaagtagtcaaacgatcatactggaatttactagcatactcatactcaatctggtccgtaggagatcctcctttattcacatcgtcaccgcgaactatgatacatccatacgaggaccaagaccccagataaccacgagcggtcgcatatacaccggaaacaggcatatacatattcgatttattcgtataatcaataccctctacctctacagtattctctggaagcttatccaagtaatcactacaactggatgtcagcaatgaaaaggctaaagggatagcccataaaatctgttttttttaatatatttttcatatacttctgattagcatttaaagattaataaataatacgaagacctaacgtataagaagatgctaaaggatatacacgctcatcaaatccataagaagaagatgctatctcacctttctcgttcttactacccaactctgggctgaagctgtttgccttgaaaacagtcaaaggacgatcagcagtcaagctcaaacgaatgctcggcatcttgaattttccaaagtctttcttcgggaatgtataagcaacttgtacattctgaatacggaaataagaaccatcttctacatagaatgagttaaagttagagatattccaaggttttacagaacctttcgcagacatatattcgttagtagagccctcacctgtccaacgattctcgaactgatctaagtcatagttcaattcagagtgccaacggcggtcaccacgtttacggtttacgatctggtttccagctacaccttgcataaccatagagaaatcgaaattcttgtaagagaatcctaagttgataccgtaattgaagttcgggatataagaacccaatgttacacggtctttattatcaatcttaccatccttattttggtcaacatacttgaaatctccgggctccaaaccatttgctacagcaatcggatcagcagcgatctctgcggcattctgataaacaccctcaatatcatatccatagtaagcattcaactcaccaccaacttgagaaatcgtacggaactccgcagaaccaccatataaataagataaaccattcaaatcttttacctcattgtgcaaggttgtcaagtttgctccaatgtagtaagagaaatctttaccgatcttatcagcccagttaaaagacaactcaacacctgtattcaaaatctcacctctgttacctaataagttaccggcacccattggcagaggagcgtcgatcacggcattttgagtcaaacgataataccagtctgcctctattgtcaaacggctattcaacgtacgaaaatctaaaccgacgttcgtctcattcacgacttcccaacctaaccaactaaaataaaccaagttcgtataaccaggaacagcgcttcctccaaatataccagaggtacccatatcttgcgtaatggaagcgaaaccatcactagccgcaaccttatcgttacctaacttaccccagctcgcacgtaatttcagataatcaacccatttctgatctttcatgaatccttcttctgaaatattccaagcagcacctacagaagggaaataaccccatttctcttggtatttggaagaaccatcagcacgcattgtagcagacaataaatatttgcctttataatcataagatacacgaccgaaccaagaaacaccacgataagtcgtaccgtcatcgccagttttacgtccatccgcattaccttgattcaaatagtaatattcctcgtgtccgcccggaacacctgtagcttctccccataggttacgccagttctcttcacgtacggattgacccaacatcgcagttaaaccatgatcaccgaacgtatctgtataggtcaatgtattatctaaaatccaactgtgataaatatcattcttcttattcaaaaggggagtcgaattcaactgagttccaccaaccaaaaattctggagtataagctcttgtctggataacattgatatcttgactataagccgttttaaagaataacttattctccggcaagaagtcgaattgcgcatagaaagaaggcattacgcgcaacattgaatttttagaatcataatactccgcttgagcaaccggattgtagtaatactcactcaaaccgatttgggcaggagaaccatatttcgtaggatacggattcaaggagctattttcatcatatacaggaataatacccggtgtacggaaagctgctaaccaaacctcgccgtttggcaagttttgcgtagagttgctcaaaacaacgttagctcctactttcaaccaatcaaaagccttataatccgctttcgtacgcaaattgaaacgagagtaatcatttttagaatccaagataccatcttgatacaaataagaggtacccacagaataagtagctttttcagtacctccagaaatgtctaaagaatggttgtgagttaaagctgtatgtaagatctcatcataccagtttgtattaggaagtgttccccaaacatttttagcgttatttacaacagcctgtaaggtttcattacccatctcactgatcatagtcgcatattgctcactattagccattttcaatacattcgtagccttttgaaagccaacataaccatcataagtaaccgtagcaggacgattcaacgcacctttctttgtcgtaaccaagactacgccattcgccgcacgtacgccataaatagaagcggcagaagcatctttcaaaatagacaaatcttgaatatcactattattcaagaaatcaatattatcaaagaacattccatctacaacatacaaaggttggctatccgtattcatagaaccgataccacgaatacgtacggaaggaccggaacctggctggccactattcgtaatctgcacacccggcacttttccttgcaaagcactcatcggagatgatgtcgcatgtttcgtaatctcatcagccttgatcacggcaattggagctgtcaaatccttagccttactcgtaccataaccgataacgacaacctcttccaagttttgcgtatcctcactcataagaacatttactacagtctgtccgttaaccggaacttcttgtgtagtcatacctacataactaaatactaaagtcgcattcttgggaacattactcaaagtatagtctccatccatagaggttatggtaccgttagtcgtacccttaaccaaaacactcaccccgatagctgggtatcctgtggccttttcagttaccacaccggtaactgtcagattctgcgcaaacattgttgtcgcggcaagtaacaggcataaacaaagcattaatttagctttcattcattctagttttaaagttgaacatttgtttttacactcattattaaatttgaagcaaatgaacacccaaacctaaaaaagggcaaatttttgtatacttcaacactactgcaagccttgcgcaagcagaaaattactacttttatactactgcaatacatattaattatcttattttcagttataatacatttgttaattcaaaaggagaacattatatgttattaaacacatctcactaaatatgggaacacaaaaatgacaaggaaaactcatagttatgattttcttatttcatagttatgatatttttcattcataactatgaaatttcttagtggaactggatcatgaaatctaccaagctttgcccctccggtagatttagttttttacgcaatcgatagcgcgccgcctcgataccacgtacggaaagattttgcatacgagccatatccttagttggcatattcaaacgtaataaagcgcataatcgtaaatcgcccggagtcaaatcgggataccgctcttttagattcgtaaagaacttttcgtggatacgatcgaaattagtctggaaaatggcccattcatcctcgcctgatatattctcttcgatcatgcggatgagcttatcgaagaatcgtttcgtataacttcccgataattgttgagcttgtatttccttttttagaccttcaaggaaatcattatgagagataacagacaaagtagcactggctaattccttactcttataagtaaggtcattttctaatttttcattctctagcttgacaattaattgctcttgcgccctcaattgctcttcttgcaatctcttttgctcctcgttaacttttttctcacgcatgacaatccacatcgtatacattctcactaatacgaccagtatacataaaaacaaagcaaaatagatgatcagcgcccaccaagagctataaaatggacgttcgatcttgaatggataagacagagaagatagctcttttcctcgatcgtctttcacaaccgcatgtaacacaaaattaccatacggtaaattagaataagtccgttgaaaattactggtgccttctatccattcattatcaaacccgtccagtttataatagatcaggaaacggcgccccgtaaaatccggatacgaaaacttaaaaagaatcgtattatagctataactcaatacggacgcaccggaagccggtgcgtccgctcccttgcaagggagcggagcgaactcattttcatgccgattataggcccttacctgcgacaaacttaatggaactcgagtcgtatccacataattccggtatctgtcataacgagcgatccccccgtttagacaaaaataagacgtcccgtcggaagccacataaatatttcccctatcctctatggtcggattatcaaacaaagtaaaaggaatacgctgttttaactggaatcgcccagactcatatcctaacaatacatattccgaattccggataaaccaatataaatcattattcaaggaaacaacccgataggtatcgcttaactcgggaaaatcctcattcaacaaatcataaggaacgatctttccagtcaaatcctcataagtataaaacttactcccatccgagaaaacaatacgtccgcgtaatttcattacattaatcgtaccactctcattaccttcctccagttttccgatatactccatctctttcacgctcctcaaatcctcattcaagcgaagacgatagatacctttatacatatggctagcccatatattgccggtagggtcaacctcaaacgatttgatcaaattagagaatccttctacattatggctaaatttccaacgattagtaaccatatcccgggtgaaaacactgagtggacggtaagacatctggagtaaaacttcctttccatggataattgtcttacgtaatgcggtaccccctccattgggccccggtatctgagtagcttttcggccctctagctgtaaggtacctgtattatgtccggcaatcagttgatttccgacatcggagatataccatgtctgttcttgagtaccgggaatcaaggttggataactatcattctcagataacgcataaagaccttggttcgtagctaaataaacaatacccttctctatcaccatatcatgcaccataccaatctgggcctcaagcggttcataaaaatagatcggagaattcacatgtatctgcgcgataccattatccaatgtaacccataaattatccgaattatcagcaaatactctcaataccgtattattaatcaagccattctcccggttgatatgccacaaagtttccccctgcttattaatcgctacaaccccattagaaatcgtacccacaataaaagtagaatctttcatcatgactccccggtttgcgatcccttcctttaatatctcattggctggtgtattccacacagacaattttttacgcacctcatcatagataaaacatccactacgagccgagaccaataatagctgatgatcaaatggcaagaccgaaaccacatcatcctccaaaacctttttcgatagtaactctgtaaactggccgtcatccattcgacaaaagcttcctccctccatgaactgaacgtatagatgatcgtctaatgtgaaaatatacaatggagacaggtcggatacaccttttcttactttttccccgtcataaataaaaaagctccggaatgattgaaaataaatctcacccttatattcattaatcgtccagaactcatcattattaagatagacgttcatctcagacgaactgagtgaatgataaatcagatcattctcgtcatccatctcaaaatacccgaactcctcgaaagagccgacataaatacgtccgtccttcgatatatacaaagcacggacacctagattattcggtaatttcacaagatcccagtgaataccgtcaaaaaccaaaagcccccggttattcccaatatacatctttcctcccggaccttgggagacggcccaattctggtttcccgctttgtaatcgcttacggaataattgatgattttaggaatatagggtaccttcgcattccccgttatacaaaacaacaaggcaataacgcaacaaatcaacatacgaaccaacgtcctcttaagtatctccttcactatatagtacagaatgttatgtaccacaaaagtaaataaaaaaacatcacgttacaccctacttcttataaactctcacataatcaatctcaaacacatgtggaaaaagagaatcatcaatacccttttggcctccccaattcccaccgatcgccagattcagcaagatatgaaagcgtttatcgtaaggccaaacctcatagcctgtcccctcgttcttaaatgtaaagtataattgatcatctacataaagccggtactcatcttcctcccattccaaggcatacacgtgaaacgctttataacaatccggacacgcaattttagcatttttttgagttccgatcgcatgattatatttttccgtatgcgaagaacctacgatcgtatcgggatcatagcccacattttccataatatctatttccccgctttttggccaatccccgtattcccaatccgttggaagcatccagatggccggccatgtccctcgtccggtcgggagtttcgcccgaatctcaaaacgtccgtacaaccaatccccttttcctttcgtaatcagacgagccgatgtatatgaacgaccttccatcggttctttcaaggccgtaatcctcaataccccatccgagacccaagcgttctcctttctgccggatgtataatattgagcctcgttatttccccattgatatacattaccttccgtatcataagaccatttcgtagaatcaggaaatcccgtatagtcaaactcctcactccatatcaatttccacccgcctttatccatgggtgcagacaaatcgatatcactagcattcgccagactgctcaagaaaacactatataggataaaaccaaacaaaagaaatgaacgtgacataacaatatagattaagatataaaacagaatttccgcaaatgtataaaaatcacatcaataaaaggtcataaggataaagtcttttacactttatccttatgaccttttacaaatagtcttttaaggctataaatgaatcaatatcccggattttgttgcaatttattatttttctgcatttctaacgctggaataggaaatattcctttataggctggagttattttatttttctcccaccaagttcctgtaaagaaagtcccaaagcgtatcatatccgtacggcgatgatcctcaaaaacaaactcttttttcaactcatcctcaattgtttgtaaggttattgtttctggggttccggtaataccggcacgggaacgaatctgttctaagaaaggacgcgccttctccggctgatttaagcgcacataacactcaacttgcatcaataacacctccgcataacgcataactactaaatcatgatcacgttcccattcctcaccatctttttgctcatatttacaccaatgcactccctcataatcttttgcgtccatgatatcaccaatctcatccgtaaaacttaacggttgaagtccctcctgattcggatctcgatcaacaacttccccagtacgaagatcgatctgatcaccgatcaacattgtattacggcgtatgtctttctcatcgaagctatagtataatccgggttgagccacaatactattaccacctccctcaaaagctccagttgatgagattgcccatctttgctcattatgcgttaaggcccaattcaagaaattgccacttgtacccattttatggtcataaggtatagctaataagatttccttagaaacctcattctctgtctggaaattagtaaaataatttgtttccaatgagccagatatttgctgacaagctttaaggcaatcctcccaacgggattttccagaaaagatctcggcattcaaatacaaacgagctaataaacaataccctgcgttcttagtcattttgccatagccggattcaggcaattggtcaataatagctaataactctttttccgtaaaatcaaaaatctcagccctcgttgagttcgtcggtaatgtcagatccttatagtccgtaatcaatggtacatttccgaaccaatcgatcaagcggtaatagaaataagcacgtatagcccgtaattcagcaaacatcttatttttctgttcatcctttaaagaagacccttctatttgtgagataatagcattaaccgtcgagattccattataacaatatctccatgccccagtgatagccacattctgattatcccactcatgacgtttcaactgaacatatcttccgccatcataccaatcggcacctccattccgagccggaagtaccgcctcatccgagctaatcgccgaaataaaatagacatactcactaaaagcatatccattcgcaccatcaaaactgcctccacggagggaagcatacgcacgtcccatgatagaagcgatttccgagtccgtttgcccatattcatttgcatttatcttatcatacagattctcggacaaatcggtacacgccccaaacatcataagtaacccagccgctaatattgattgtattttcataattctcctgtttttataaatgattagaatgatagattaagaccgatagaaaatgtcctcggcatcggataaatattacctttatccagtccaacttcctttaaatctgaagtactaacttccggatctatccccgtataaccagttaatacaaacaaattctctcctgtagcatagaaacgtaaacggttaaccccaaaattcttcaggagacgagcagggagcgtataacccaaggttacactttgcaaacggaagaacgaaccattttccaaccagaaatcagagtaaaccggcatattctcatcagagataccactttcagcgaaagaggaagtgatattataatttggcatatgggccgtataacctctttccattcccgctacattcagtaccttctgaccatacataccataaccagagatacccaaatcaaaatctttatacgtaaaattaaatgataagcccatcgtcaattttggttgggcgttacccaagatctcgtcttctccatcatttgccaacacgaatttaccatctacaataccctcgcaatgaggcccataaaatgttcctacaggataaccttcctctataacctgcgaataacgattagacattcccaaaataccttgtagcgaaccacttaatattcgatcggtttgataaacttgattagatagtttatcaattgtctgtttgttatgtgccaacgtcaaattagcgtcccaagtgaaatccttatgattgataaggtttgcccccaaagtcaactctacacccttattggtcaaatcacctacattcgctaaaatgctagaatacaaataaggaggattaggtacttgatacgtatataataaatcactagtctttttcaaataccaatcgaacgttaagtttaaacgattgaacaagaacatatcgacacccacattcgtttgggcggtagattcccatttcagatccgggttcgggttctgagtaaccccatacgattgtttccaagaattactctcgctatcaaaataagcaccgcctcccgtacccatcagcatagccgatttatattctccgatcccggattgatttcccgtcacaccataaccggcacgtaactttaaattagcgacccaactctgtaagtcctccataaaagcttcctccgaaatacgccaagctgccgatacagacgggaatgtaccccatttatgattagtaccgaaacgtgaggaaccgtcacgacgaatcgtggccgtaagcatatatcggtctttcaacgtataattagcacgggcaaagaatgagatcaatttcgcttggctcttagaagatgctacgtcctccaatcggttatcctgccccgctcccaaattattccataaaaaatcatccgtgtcgaattttcgtctttcggctttcagagtctcaaacgaataatccagataagaataaccaaccatagcgcctatacgatgtatcttattgaatgtcttgtcatagtttaaaaaaacctctaactgcttattcgtatattcctcgttatatctcttagcgtatccaccatctgtaactttataaacataagacggacggtaataataatcttgatttgaattatattcataagataaattggtggttgctttcagtccgtcaataatggatagttctaccttaccgtaaccgagtaaatgcttacgggttgtctcatcatttcgttccgtatggctctccaccggattattttcagtcaatcgtccaccgacctgctccaaataattcccattctcatcataaataggggctgtcgggttcatattataaatcgtactataaatgcccttatccacattatgccgtttatctgcattagcctgtaaactcaactcaactttcaaccggttattaagtccatattgataagcggtcaaactagcactcatacgatccaaatcactaaacttaataataccctcgttccttaaataattcacggatgcacgtagcccattatcttctccaccggaagagaaggaaagcgtatgggaatgagaaatagcggtttgctggatcgctttctgccaatcggtattggcaccataatctacggcatcggtcaaattatgatcacttacatattgacgccattctccagcagtcaatacatccaaattattagcgctctttcctatcgctacatatccattgtattcaatactacgcccttttttctctcgattggtcgtaacgataatcacaccattcgctccgcgtgaaccataaatagccgtagccgaggcatctttcagtacatccatagacaggatttcattgggttggaccgtactgagatcaaccccgggaataccatccaccacaaccagtggcgcattactggcagacaaagaggtacccccacgtaaacgcatggaagaacttttcgtcggatcaccaccaccttgtgagactaccaaaccagcgaccttaccttgtaacaactgctccgcagaagaaatcacgccttgcttaaaatccttggccgaaacagaagcgatagagcctgttaaatccgatttacgagaaacaccataaccgatagcgacaaccgttacctcatccaaaccgatagaagtcggtttcaattggatattcaactgtgatttagcttccaccgattgctctgagtatccgatataggagaatgttattaattccccctccgttgcctctaaagtataattgccatctatatcggtggtcgtaccatttttagaagcggtaatgatagtaaccccgatgatcggcaaaccattttcatcagtcacgacacctttgactgtaatatgtttttgtgaaatctgggaggactggtttgtttctgccttatccgtttttcgataaagaacaatatgccggtccgttatcttataagcgatatcattacgatttaataattggtttaatacctccgtaattcccttatccttaacatggatactaatcctttggtccgagcttacttcctcctcattataaaagaaagaaaattcactttgctcctcaatcgccttaaatgcctgttcaatcgttacatttcgcaaattgaggttgattgcagccgtatccatatagctagcggcgaacatcgacgttgccccggttaaccccagacttagcataaataccttgaagaaatgttttttcatttgttaatgatttaatttattaattatgcttttgataattccattcctctcattgacttatttaatattagatccggatctttctatttaaggtcactcagaatattgttatctccattcatagtaaagagacaaaaaggattcgatacgcctaaaagaaaattaaaaaaaatcagtacatgatctctgtattaaccaaaccgaaataaactaagccaaacaaaccggtattccagccttggatatgataacctaaattctctcctgtcagactatttatatgttcattaggtgaccaatcccctgagtttactaaatccgcacgtcctactttcttaataatatcaatagcttcctcttgttgtcccatattaatacgtgcccaacagtccataaaacttacccacggccatacacctccattgtgataagtagccgaaggataaccaaaactatcatcataataaggaaaagtctcggcaatcccgtaaggtgtcatacttttcgtatttaaagtctctatgattttcaaggctcgttcccggggaacaacatcaaataagataccgatcgtttgatcctgtaaaatcctatcatttacgctcccatctttccatatctgacaataatagtttccattccacaagcctccttctcttacatctttattcatagtcttatatcctttttgataggcagattggtaatagttagctcccgcttgatcaccacactcttccgccaaataaaccatttcctttaaagcagataaataaatcaaacaggtaaaaggagaatattttcttccctcgatccccttcacatctttccaatctccccaaaaagaaacctgagcaggaagtccaatcttatccgtatctctagaaatcaaccagttcatggcatttttcatagctggccagtagttgatcaagtcttgtttattatgataataccgatagaatctagcaatacgcaaaataaagaaagcattgatatccaaatcatcctcccgctcaattagaggaaggatcgtagtcggaatcttcccggacggttgttgccactcgatactttcctcaatcatctttctctctaaatctttataaaataccaaatgcagccaacttgtccaataactatcgcgttgatttaactcacgatatcccattgtaacaagttcccctttttttgtccatttcgtaagtgatacgcccggaatcatataccatcgcacgtaagtatccaattctttatcgcctgttttgggaatcgctaaactaaaagctgttgttttatctttaaaagccgaccacattttatatgcataggccgaaagatcatcaagtgtccggaaattaatactactgatccagttatcatcccgaaaagtaaataagaccttgattttctttttctcgccagccaacaaagaaactgggatagaaagtttttgtccagcccacaaactttcggtttgatcagtcgtaatttggcaattatttttgttactaatgcccgtatattcatcattctcactgaagctcatatctttcgctaaattctcgtccggttgagcgaccagtgtaaaatgctcttctttagaagtcggattagaacaacaaatctctaacatcaaaacagggagagcagaagtttccgcatcattaacccccaatgggcaaaaagcctctgtagtaaaagtcacttttgtgagggacgatcctttataatcattttttacaaacggaaattcccttatgatattctttttaggaaattcagaaaataactgtcgcctaccatctttctcaatcgagaacattacggcacctctgttagttaaccaatcccctaatgtcccgggattttgcataatctgtccgaagaagtctccagatactgaggcattaacagttaacgcaaagttagcgatcggatacccatcgacaacttgccttttttgagcgaccatagaatgactaatcatccaaaataaaagaaaaaatagagaatgtgttttcatgctattcattgaatcgtattcttttaataaattgttacttgattatcaactattgtatattgaaaaggtacattaatccgtattatattgaaaatttgtggaagcgtttcattattaataaacttaccggtaaataccttatgttccaaaccaaccttctcaatcgtgatcttacaattgaactttctttccaaactcttacaaatattaccgaacgatttcttcttaaaaaacaatttcccctcagtccatcctatagcatattccctttcgaatggctctaactgaaccaccttcgtgttcttatcatatacagcagaggtactaggcgtaagatgataatgtttattatccatattattctttatctcgacagatccggatatcaagcttgtcactacctcttcttcctctccataagccgatacattaaaaacagtccctaataccttaacatctatttgcctcgttttgacaataaacgggacatgttcattacatgcaacctgaaaacaagcttctcctaccagtctcacatcacgggaacttttattataatccgtagaataagaaagcctgctcccatgattaagggttaccacagaactatctggcaataccacttcagatacgccattttgagaattaaaaacaatccattcctcttttacatcagaccgaggttttatcgattcaaagagaaaaaagcctattaataaagtgatactggccgctatagacaaaaacagatatatattttttatggaaccctgcttacttcccttatccttaaacatcttatgatatagctcctcccgcacaccttcttttatttctgaggcatgcccataatcacagtcaagcgagatatgatctattatcttgaaaatcttttttttctcctcatccagcacatctagcgcatcagatggaagatcatcgttttcccggtttaatagacttgctagtttttgccattctttttcaaccttaaccttcatatttcatttaatttttttacctgtgcgatactcctgtatgactattccaattttccttattgctatgcacatctgtgcgtgtaccgtccgatccgatatcgaaaggatctgagccacttccttgtaggtcatattttcttctctcaccataaagaaaattaaacgacacttctcaggcaaagagtttatcgctaactcaatgattttctttaattcattgtccaagatctcttgttccggtgttgatttctcagacagacctcctaaatcagcgtcttccaaccgtattttctggtacttatcgctctcactcttatatttaagagcatgattccgggcacagataaatagatagttctcataattctgtatttctggcaattgctttcggttttgccacaaatacaaataaacatcagaaatcacatctttacatacacctttctccacaagaaaatagcttgtgtatctatacaatttcatataggtataatcaaaaaacagttggaaagcccttgggtcatcattcgcaatctgtttaaatagagatcgtatattaattgtttcttccaatggatgtgatgtaaatatctattttatgatgaagagaaaaaaagagtgaagtatgcctaaagaagcagattgaataaattcgcatttagggtttattaagagatcatgacccctacttgcttatatccgctagggcattatataataaaaaaagagatgtcaaaattgacatctctctctggattgttgagttgtctcacgaggattcgaacctcgacagacagaaccaaaaactgtagtgctaccattacaccatgagacaatccgattgctttactaaagcgatgcaaaggtaagaataaaatcttaccttgcaaatttttttgattatttttttactttgcgatcaacaaataataatttttcttacctctttgaaccaataaatacttatcgtcaagcagtgaggaacagtcgattacagtatcaacctccgctaatttctctttgttaaaacttacgccaccactttgtaccaatttacgcatctcaccttttgaagggaagatagcggctttttcagtacacaaatcaacagccttgattcctgcggccaattcatcacgggagatatcgaaatgaggaacaccctcgaatacggctagtaatgtgtcctcatccaatttcaacaaagcctcgtgagtggagttaccaaacaagatattggaagcctcgacagcggcctcataatcttccaaagagtgaaccataacagtcacttctttcgccaaacgtttctgcaacggacgcaaatgaggagcggcctcttgctccgcctccaaagcggcgatctcttcttggctcaagtccgtgaagatcttgatatacttggcggcgtcagcgtcgcttacgttcaaccagaattgatagaatttatacggagaagtatagcgacgatccaaccagatattaccggattccgtctttccgaacttaccaccgtcggccttcgtgatcaacgggcaagtcaaggcataagcctcccctcccaacgtacgacggatcaattccgtaccagtcgtgatattaccccattgatcggtaccacccatctgtagacggcaaccctcatgctcatacaaatacaaataatcgtagccttgtagcaattgataagaaaactcggtgaaagacatacctacactagattcgcggctcaaacgtttcttcactgaatccttagccatcatgtagttcacggtaatatgcttaccgatatcacggataaaattcaagaaagaataacccttcatccagtcatagttgttcaccaacttagcggcattaggagcgtcggagtcaaaatcaaggaacttagccaattgtttcttgatgcaatcctgattgtgacgaagagtagcctcgtccagcaaattacgctcggcagacttcatagacgggtcaccgatcataccggtagcgccacccactaaagcgataggacgatgaccggcacgttggaaatgcttcagcatcatcacacttactaagtgtccgatatgcaaagagtctgccgttgggtcaatccccacataggccgatgtcaactctttctgcaattgctcttccgtcccgggcatcatatcagcgatcatgcccctccatcttaattcttctacaaaattcatcgtattaatttatatcgtattacattaatatatttgtcactttatctcatacgaggcaaaggtacgactttttaattgagaatcgaaaattgataattgataattatccgtttaggtggaagatagaaacgtttttagcgatttgaatccgcagcttttcttccggaatatccaacgcttccgctacattttggtagaccccgcggatatcaatcgatttatcatcggtctccaagaaaaggaaatcaggccatgcggcacgcaaagccgacggattaaaacgatctccaaaagagagataaaaccccaagcgaaccaattgggaggcaagttcaccattacctcgaaagccatggataatccaaggcatctccggtttcacggcctttttacaggcaatgagatccgcccacgcttttacgcaatggatgattaatggcttatgtgtttcctccgctaaattggcttgtgccagaaacacctctttttgcaaatccattggagattcggccagtgtatcaagtccagcctctccgatcgccacgactcccgaaccagacaccaataccctaagtagatctatctgctcctttacattatatatataccacggatgaataccatatgagcgaataaccgtatcaggaagtgaacccggctgcatatcacccattggactcacgatcctatttataatcgcgatatcctccttatggaaaggcatctgatgcgtatgtatatcataataacccatggcgttacggaaccggatcataaccgctcccaccccaaggatggcaacgaagtattcgtttaaccgcaagatacaatcctttcacagggccatatttcttcaaggcttgcaccgcatattcggaacaagtgggcgtatacctgcacgaagccggtgtcataggagagatacaatatttgtagaaataaaccggcaataagagtaatgtggtaaaaaagcgtctcattattctttatcccgaaggatatggatcgctttcttcattgccttttccatcacagcgtacggatggatctctttatcgaggtacaggaaagcgattaacatgcccttattcttcgcttccaacggttccagtaaatcatatttacgaacccggtaagcctcacgtacctgtcgtttgatcaagttacgttttacggctctcttaaatcttttcttcggtacactcactaagaaggaagcacgggcaggcatctcttcctccatcggtaaataaacgacccgcagtggaaacgccacgaacgattgtcctttttcgaataataggtcaatgtaacgtttccacgacaggcgttcttcttttgaaagggtatacctttttgtcgtcattattttttaccgtcttgctgttttttcagatataaatccaaagcagcagtcatagaaggggcttccaccgtgggagcctcaacgtccaaacgcagacccgcatctttaacagcctttgccgtagtagggccaaaacagccgatctttatatcgtcttgtttgaaatccgggaagttcttcaataaagaagagatacccgacggactaaagaaaaccaacatatcataatcgaatttctcgtccttcgcgaaatcattgctcaccgtacggaacatcaccgctttcgtatagttgattttcttcgcatctaacaaagcgaatagatcatctttatgtacatcggaaacaggtactaggtatttctccttcgcatgtttggcgataacagtcaccaaatcatctgccttaccggtctgaccataaaaaatcttacgttttctataaacgatatacttctggagataaacagcgatcgcctctgtcatacagaaatacttcatcgtttccgggatagccacacgcaattcctcgcataaatgaaagaaatgatcgatagccgtacgagccgtaaaaataacggcggtatgatccaaaaccgagattcgttgctgcctgaactccttggaagataaaggttcaaccttgatgaacgggcggaaatctatttccacaccgtatttttctgcaatatcgaaatatggtgatttctccgatgcaggcttcggttgtgataccaataattttttaatattcaatgccatagagtacttgactcgataaagttatacaaataaataatgccttcatacagaaaaactaaaggcaatatttcttggccgcaaaggtacaaactaatatataaaaaactgctatttttcctgtgaaatatccgtatggtcttataaattatcacaaaacgacacagaatataaaaaaatacaaacaacaaaacaggaatttgtatactgctccccacgaataccaaccaaagtgccggaatgtataaacagatcccccacgctcctataatagcgttataattagtcttccaaaacttgtatttcggagcgtccgtaaaaacaacccccaataaataatagaaacagcgcttacaccaataaaacagcatcaataccatcattatcaacccaatagatatcaacaccgtattttctagcaaatggttgaaatacccatatgccttagcgatagcaaaaagacaaacgctacaaagaaacaaggcttgaaacgtcatgaaattccggaagagccattcgctccccctcgttacctcaaataaattttgacgttctttcacatataccacatcacgcatcatcttcaggaataaacgataattggtacggaacaccaacgcaaaacacataaataagacgaacaaaaggctaaagaccacatcgtccaccaattgtccgtcccacaaacgaatccctacatatccttcaaatgtacccatgtgccgctattatcggcacaaaggtacataattatttcaataaagcgcttccttaataatctctcctaccgtaggatgcgggaacacaaacgactttaactcatccgatttcatccccttctcaatagcgattccggcgatcacgatcaactccgaggccggattacccaacatatgggcaccgatcagcgtctcatcctccgacaagatcaacttacaaacaccattccccatctcattctccgcgacaaaacgcccagagaatgccatcggtattttcttcacggtatacgaaataccttctgcctgcaactcctcctctgtcttcccgacaccggcgatctctggattcgtataaacgacacccggaatagccttataactcatcgggcgcgatttgcccaagagatgatccacggccacctccgcctcgctaactgccgtatgcgccagtaaggaaaaagcggtaatatcaccgcaagcatatacatttggcagggaagtctgcatgtactcattcaccttcaccccattacggaaaggctccggagccagtgtctccaagccaaaacctttcgtaaccggacgacgccctacactcaaaaggactttatcgccatgcaacgtgaatgtctccccgtctttctctacagaaacctcggttccatgcaccccggtcactttatgacttagatagaacttgatcccccgtttagtgtattccgcttgcaacatttcggacagctcacgatccatcgggcctaatatcttatccaacatctccacgacatgtacctctaccccaaggctattgaagaaagaagcgaactccataccgatcacgcctccaccgattatcaccaaagaggccggaagctccttcgattgcaacgcctcccggctcgtccaatattccgtctccgccaatccgggtataggaggaattatcgtttctgatcccgtacagatcaaaaggttcgcagcctcgtatagctcttctccggcggcgatcgtaatcgtcccgtcggccgcacgcccttggatacaagcttccgccgtaaccatcaccacgccatgctccgtcattttcatacggataccggctgtcagctttttcacgaccttattcttacgggcgatgattttcgggagatcaaaagaaggattctccgctttcaccgcatacttggaagcatgcttgatattatcatacgtcttagcggaataaagaagcgtctttgtcggcacgcatccctcattcaaacaaaccccgcccaatgcgtttttctcaaaaagaatcgtggaaagcccaccctgcgccgctctctccgcggcagtataaccggcaggacctccaccgattatagcgacatcgtatttcatactattagatctatttaagttgtatattaggatttatctttctcaactgtttgataaaatcagcccggttggtcggagatatgagcatccaaggtttcccattgctccatatgatcagccgatccaacgaaagggcgtagctggacaccggcatcacggtagattccaacgcctctatatcagcgatagcgatcttcttctccgggaaaatactacaatgcgctatcaacacatcatcttccgttatccggtaatacgtattaaagaaaacatgaagcacccccaacgcagcgaccatcatacccactatagccgatatattggtacgcaaaaacgcagccacacaaccaattaccaccatgataatcaccagatgataccaccatcccacttttgatttatattctctttccattttccgaaatttgccgcaagttaacgaaaaacgtcaaacaaaaagaaaattgcccaatctttcctataaaagaaaatacgctgtcacttctcagcaacagcgtatccacttaaaccggttaatacaaatcataagattgtagtcgccttttttattttaattcttccaataccgtataggattgtaatacgttattcttatcatattgttccgtacgcactaagcctacattcgggctgtaccactcatagccatacccagtgattgtctcctttgatttaggggaacgtgtagcgatattatattttaccttagcgcaatcgaacgtaccggcaggagttgttatgctttccgttttaataaactcacggtccttaatggccatatccttacgattcttccgattcttcttatcgtagatctttacggaagcctcgtcgaaatacacgttattcttatcgaaattagccgcatacggatttgggtaatttataaagttctccgtgatatccacattcgtattcatttccgataccactcccggataagagagtgtctctttcgagtcgaggaaaaattctccattctggcagtatgccttgatatctcctttgttcacgatcgtaccggagggattagtatatacgtagtccgcttccacctcttggccggaaggcaatgtttccacctcatccacttgataactcataacagattgtaagtttcccttcgcgtcatatcctttacggacccataccgttccctctgtttgcggaaagaagaacgtacaatcttgcgccatcgctcctcccgcgatcaatgagattaaagccgtgtataatattttcaccttcataattttgacgtttaattaattcactactaaatacatgccggatatccaatgctttgttagaacagagtgaacccctaaatgttcagaaggtaaaaattaaaaatagccaaaatatcgtaaggcagcggtatatcatccactatcaatggataccgaatatagcatcttttacgacgatagaatcatttacatcgtacctattatataaagtcccttccatctttccctcaatatatggcatcatggacgattcatggtaacgaacactatccacatagaccttaaacggtttttttaaaggacaatattccaccttatttagtgaatccgttatccggatataagacgttatctcctcttgtgtccgaatccccttctctatattatattctccttcttgtaatgggagcaataccaccttcatcgcataacggcttgaatgttcgcgatccagtggaatcgtccaatgcgaacatctcaagacctcccattctcccctccttacttccgaataaaatccagcatctatatatctccatgaagccgacttattcctaatagaaatatcctgtccgtttaccgccccctcaaaatatcccagataatagggtgtttctttaggtgtatcctctattatctcttctttctcgcaagagataaacgccaactgcaaaagaaatagtgaaaaataaattaggtatctcataacgcatatattttagaagtaagacacttatattcagagctatttccaaagatacaaactttatccggatttcaaactaaaaagacgtagaattgaagttctataaaccaaatacacacaaatcacttcctacatatgtacgaacctctttactatacaagtttccatatattatattatcagttacatttttcttagataaattcaatccccaatgatatctaaacattaacctattctcgccttccttaaacaatggggatgatacaattacggggtagttaatctcatagactaaaccggacggtatattttgtaactgatccgattttcccttcgacaatatgaaactaggaggcattatactagaactcattcgcatagatttttcgtatatcataatcactcctcccggataaaacagcttatccttatccgatatattcttaaatcgcaagcttacccttacagtatcacccatcaaaacagtgtctcgatcagttgcaatcacaaggctcatattttctacgatattcccatccggcaataatttatcttgttctttctcaaacatcaatgactccgaataatgccattgtccactgtccttgcttcttttaagaacaaaattatagaaacttttagcggccaaatctccattttttgctgagatgaacctaaatgattttgacaattcctgtatagtattcctatcctctccatccatacctttctcccaagaagacgagctacaataaggtatcccattctcatctatcaaaaatgttataaaaaaatgggtatcctcataattaatctccgataacttctcacaaatcaaatccgcatatttaccggacgatctcatcaaaactggtgggacaccccaccatgtcactagatgattttccatccatcttccatacctatcgtaatattctttatcacaatcagaagaagtgtcttgagcaaatgcagttacactgatagacaacatcatccataaacatcctattttcaacatcttgataacattttttcgtcaatactagaaatggaatcgtacccccgcatcaaaagtcaaacgaaataagccagagtaatctcctttatcgtaagagacattctcttgcttgggtaaggaacctcctacataaccgatattcaagcccactcccacatgctttgacaaaagatattctgcgcctaatgagaaattatatcctacaccggataaggactcgcttatccccctcgccgattcccggtaactaaaatatcctatacctattttctcttccacgatccatcggtttatgatttgtttcatcacaaattgaggagcgacataagtaagccccacgttaatatctattcccgaataagtataagacgatttatatcccgaatacaataagccagcaccgaaaccgctccttgatatccaatcatacccaacttgccaatccaatccgtttttaggatggccagacccacccggtggcaaataaaatttactggtcacaaaagcgtaacctatattcgcataaatcgtgttatgctcaaatgaagacttctccacgacagcctcttcctccaaatccaaagctttcgatagaggagcggcccgaaacgccgccgtgtccgacactaaaagcatactaccggctatctgatggcaactactacccaataatgaaggtttccgatggtctgtcaacgccaatgcgttacctcccgcttttgccgtttcttgtttcgccaaccaaacaacctgatcataattacatttagtagacactccgttatccactacagaaacattgccgatcctctctgccgaggcaggaacagcctcccccagctcatacaaacgaaccttatccgcagttacgcttgccgggtaacttttagagatatttgtaatgactttgggcgcacatcctgtcattagaaacagaaaagagacaaataagacagacaaacatttaatcattttcatttttcatttataagttcaacatccactttctaaactcctcattctttctaagtacctagatttaataataaaacgtgcttagccacaaaaaattatttatcacaaaccattctatccaaaccattgaacaagcccttaccttttgctgtatgaaaccaacatatcaatatacaaaagttcaaacaaaaaataggctgtctcattttccatcacgaaacagcctatttttaaataaaccccttcttattaccgcttaaaatcaagagaataactctgcatacattttgaggtagcgctcccgaaattgcaacgctatgccttttcccatcgctccggcgcaattacaaccatgagcgtaactgcgaactccattcagattgaatatatcaccttgctttataaaattaaccataaatcacatctatctaattttctccaacactccatcatcaaatcctacagttatatacttagtatgtaataaccaagcactaaccttctccaatgaaataatgtccaataagatcgtaattacctcatttaagaacttatccggatccacatcaacaccttcaatatttagatacttatcgaccggctcataatcaacatcacaagcccaatcatcatcgtccacatcataactttcagagcctatcaaataaacacaatatccattttcagactcaaaaataccaaaattcagtgctactatattttctggtatcacttcattatggcttaattccaaaagccagtcttctatctgtttcttcatagcatttattcttttaaaaatacttcaaacatataaagcacattcgataaattaagttaacacaaaatttatttcattaaatcaacgacatccattattcgttttttatctttctctgaaaaaataaaacatacagaatgatcattaaaaccagcccaaaatgaaagagttattttaattattttcaaatacattcttaagtcatactcatctaacaatgataaatcttcatgtattattacaatatcattattagatatccagtcaaaatccctataaacttcacaaagagcatcccaattttctccaaaataattaggaaacactagagcttttgataagttaaggaataaatccattttgtctcgtactttatatacatatccaataaatgtatcctccactagatacattctaggatactttacaaaaaatatattctccatctaatagtagttttagaatacaaatgaaagaataatattatatattcacatacttataacgaacttttttcaaaatttgatttgaatcattgttccataatgatctggagtaaaccacatcttacttcctcctgtgataactctcataggccctgctcctcttgtcaaaccaggcgtaggatgaacatactctttataaacaccatttgataaatttggcaactttccttcattattataatagatcgccccatcatgacgaaacgtaaacaactttccagaccgtattctatcaatagtcggttgtaaatcatgagttaccccatctggagttgtcacaaaacgagtcgtacccgaagattgactagaagaagcgacctgagatgatgtctctaccggatttaatttaggggtattactaatatccggttgcgtcacatttagcccacttcctggagcctccatcaacctcatctccggtgccggtcttgttgccgtgttcttgaacgagaagattgtccgtccgaatttaacgtccttacctgtccagaagttattacctttcaaggcggcaaccataccgtttccgattccacctgtcaaggcaccacccaaaatacccaagccataatccttcaagctcataaacgggtccccgaaatacaacgagttacccgcactttggacaggcatcatcaccgccgtactcgccgaacctgcggcggctccagccaaaaagcctccgattcccccggcggcacctccagcagcggcaaaggccaacccaccagtcgcagcccccaaacctccggcggcggctccaataccaaatgcggcaaatccatccttgaaactatgaagttgacccgatacagccttatagatcaaatttgctgttcctccgataaccgcacctattataatatggataaactctccatcctcgtccacatacctcaacgggttgttcatggcatagctgtaacgattgaagttctgggacaagtccggcatctggacaaacggatcaggagcgaggaaacgacccagagccgggtcatacaggcgggcgttcatatttaccagaccaaactccttaagatgttcatggccactgtagccacgaccaaggaacaactctacctcctgccccgaagggatgtaaacgtgactggatgagttacgttggcgaccccatgcgtcaaaattataactcgcgtatttcgtccctgcctcggtgatgatatccgtgatacttcccagataatcacgacctatataataaagtttccagctattcgtatgatccttcaccaataccgccgaagcgtcgtagtaattctctcccgccaaatacagcttctccttattacccgagggagtctcatcgatctcatagcaatcccccaaataatagcgggtcaacaaacggctaccccctttagccacctgcatcttcacacgctgctgattgccgttataggtaaacgaggccacgttaccatcttgcgtaatagcgttcggacgcttgaaagaggtatagctaataacctgtgtggcggaagacataataccatttgccacgctagaggaagatatggcgtaaggcttgccacttgtattatatgcgaatgtaccactgacatcccctttggttaagatatttcctttcgcatcataagttgccataagccctttgtaggaagtcagacgattaagattatcataagagaatttctcttcttgggatacattaatgtctttccggtaagtcaagttccgtttaacaggatcaaaaacatactccatattctggaggaatgtggtcacccctgttttctgtatcttcctggaagtagggaatccataactgtcatatccataggtacgagataaggcaccggagcgtacctcggtaggtaaccccatgtcattctctttcgtgagcttaaatatggatgtttggttattcagcttggtctcaactaaatgaccattcgcataattataattctcggttgtcaaaactccggattgagacgtatacttaatagagcttacatttcctccgttataggtataatcctttcgtaaatatttattgtctaccgccgtctctgtctggctcgacagacgacccaacgcatcatatacataatcaatggaagttccgacagaagaagagaccttcgtcaactcatcgtagccattataagtatatgtagtcgtaaactctggtaaagtcgccgttttaaggcgattatacgtatcatacgtgtaattgataaccttattatttgcgttcgtctctttcaataggttgccggatgcgtcataagcataagttgtcgtaccagagctaggatcgcccaagctagtccgacggccgaaaccatcataaccaaatgaagtagtcacgttacccggtgcgacgatagaagaaggttgtccatccggacgcagattataggtaatcgttcctactgggtctaccacagatataagattgcccaacgcatcatacgtccgcttgacagagattccatcctccaccgttgttatactattgccgctataaccatgagtcgtttttcttccggaaggttccgatatagcggttaagcgatcatacgtatcataactatagatattccaagccgtagccgaactaccggcaaacggacgagagactttttgcacccttccataactatcataaattttatccgtttttagaaaactgccattaaaacgagtctcggccgttcttacctctctattcaacgcatcatatacacttttagtagtaggtttacccgtcacagaacgggttatggcatacaaagcgtttgtcccttcctccgaccatccgtaagatacagtagcggtagtattatcagggaacgtgacacttgtctcccgaccaaatggatcatacgtatgcgccgtagactttccccggtggtccttctcagaagacatacgcccctccgtattataagaaaactcatttgcaagtcctaatgggtttgtcacctttttcaatcgaccgttcgtatcataagcatattcggtcttcagccctttatccgaaccatacaagaatagcgtctcttttgtgatattacccggagtatcataaacatactcgtaagttttcgctttatttccattcttatagaacaccttgctattcgcatagccgttcgtatgcgaaggaatattcattcgctcggtataagtactgctattacgagtagtagtcacgctctgatcggtcaagaaaccaataagatatccactctctgccgtattgttataaaatgtgttcgccttttttaccgtaatacccccagtgtaagtgatagtctcttgcgtcgcatttccataagtatcatatacaaaagcggtagtagccgtaatacccttaagcaagtcctgctctgtcttattgcttaaacgtatcttgaccgttttattggcttgaacattaacggcaaaattataggtcaatttcgcctcaggtgaaacctcactcttcaatacgccatatttataaggatcaaaatattgctccgtaagctgccctttcaaattcgtacggaatatactctcaaatcccctaaaccccaatccttggcggtgaataacaccacctcggtacgtgaaagtgaaattatcaacccggttacctttcatataagtactggaaaaggctatgacaggaatagactcttgaatgtccacatacgggaaaacagcgttcacacccttagcataagtaccggaagatatggcctcctcattcatcaacaggtatgtgttcttttcgaccactcccaaactattcgccatacccgtggccaaaacgcctttattgtcattcctcttgaatgaatattttgtaaccactccattcttcaagctgaccaattgactaaaataattatgactgtttatattagtcgggatcaagattgatttcgatgtataatcttgggcacattcaaccgaacccacgttatttttcttagcgaggtaagtgaagaaaccggagctatgataccggatcaagtctgtcataccatccccgtttacatcttgtagcaaaaagccatccgtagaaatccccgagttttgagtaccggcaaacgtggatttataaaattgtccatctcccatcgagttataagcggcccacgtatagactggatccttttttttcggagataccagcaaatccataagcccatctccgttgatctcccccagcaacaacgagcgatcttttagatccaccttttttaatccggtataagtagagacttttcggcccgtccaagtactaccggaaacatcaaaagtatatatatttaccccggagtcattaataagagcgatgtcacttttcccgtctccatcataatctaataccagaagtctatctgttttctgaaatgcgtcctcaggatcaggctgctccgtgcctacaaaattaacgttatagggaaacaagtaactctgatataagaccttaccactttccaaatcaaatatatagcatttagaggtcttactggtctctccaaaaggatgatggcaagagaccgctagtacttcctgttttccatccccattgaaatcccctgtataataaaacttaggatgtatgctctttgccccatccgcatcggtcaatacggtcgggaaattaaaagtccgtgtatatttagataccaatcccacagtcaaactggccctatatacacggaaagtcacttgatcattatcaccggaaacgccattgtttacttttatgatatgctcttcttgctttccctccaaatccgcacaaaagatatcgataaaattagctccggtcgtaagattgggcatgggggaagcgtactcgctattcaatccggcataaagatagattttctcttctccggtgaatttattgtcatatctattctgggaatgctgaaaagccgtcgaatgtctgtaatgctcccaatagggattctcattaggcaaagagatcaaaccatctgcccccgacgcataatcataccttcctttcactaccttgatacgagcaggatccgttgattcataccaattatatagctgtgtgacagaaccattatcataagacccatctgttatgccttctccatagtaaagctttatagggttcagagattgcccggaggcggaataatctatctggcttaaaactgagctattgttctggtttttatagctcaagctatacgtacaaagcgcagtagagcctaatttactgatgattttagccagcaagtagctttcccctgtcttaagcccccctataaaagagaccaaggggtccggtcgtgaggcttgatactgaaattccacagaggcaccattataagcaacttttgtcaatctgtaatggttttcttgctcgacataagtatataggatctgattatttcgcaagtcagacaaagaaactatcggataaaagatcttattgcttgtatttgaggcatatccaaatatgcccttggttccattaggataaaatacctcaaaatatttcacgacatcgccggacaaaaaagcttttacttttatattgccttgctcggactcataattaatagttgtcgcattctctgagatctttataagacgcatcccgtctaacacgaacgcatccgctttcgtacgtaaagctccttggggcttaccatcataataaatattcctactcgtacgcatgatcgattgcacaccgccaataccccatccaataccaacgatgccatttccttgctggctattataagccaatgataattggggttcaaatccatttatacccggataaacctgtatgggaaccgtataggttttagctccagtcggggaaacacctgtttgtatcggtatctctcctacagctttcgatttatctattgtaactgtagtcggaacgtaagtattatcagatatggctttaggaacaaaagcctgaggttgctgtgaaaacctttccggattttctgcagttttcgctataaccggaggatataaagccttcaataaagaatcctcataagccttgtaatcactttccttccaatcgaaaaattgattattctcagcaactccttgggcacataaataagaagatggggacataaacatgataaatatccctatcgtatataaatatattaatttcatctataagtatacttaaattatattttgatcaatcctcctcttggtctacgggaacggcctccaaagatgaagccatcgcactaaattgccgtgttgttctatttcctgacgcatcataagtataagtaaatatcatttgttgggattgcctaatattcaaaattccgccagactttacctcaaaaggcccattaatcgtaatttgcgccggagcggaaagagataaattaccattacttgccacggttacattttggacagccaacgtattacagcccaaaactgatacacttgatgaaactgtctgatttgtataagtactcacacagcttctcgtgtcaacctcttgtgatgataacggggaaaataagcaagtcaatacgatacatgtaaaaaagacgattctctctttcatatcaaagaatttatgattctgttatttctatttttaattccttgagattacagacttacatacttcttcaaagtatccgctttcttcccatccacaaacaacgtataaataaacgttccataaccaagttccgaacggcttacttctaccacattactacttccattatccaacttaataactttcacgggtttacctgtgacatcaaatatctgtagactagcagacacaaacgtcgccggtaaggtataagagacagaagcaccttccctattatataattttgcgctatccacagcacttatattacttgtggaagtcgtgctcgaacgtaattgagattgtacctccggcgatagtagagcttgcaaattatcaatcacctcattctgttgttggatcgtttgttgcatctccttgatactttctacgataagcggaataaaacctatataatctatagacatcatcccgttttcatccgtttgtacaagttcgggtaataccttttgtatgtcttgagccaaaaaaccaattcgtttacgactagcctccgctgcctctcttcgatctatctctgcttggatttgtttgtctctatttatctttgcgatagtagcggcatccataatctcctctgaatcggaggaacttcccgatatcccattatccaatgtggcagagaacttagactcatcctgctccctattctcctcaagtgtagagaggttgtatgaataagagaccccattcacttgctctaaaagagctaatggattttgcagcgactctacattttccttcaagcgagcgtctgaagttatattcactccattcacacgaagattcgtattgaacacgaaattagtattactagccggattgtaatacgccacgacattgttagcataaccatttgtagtcatataaatacccaatttcccatgcaaccaaagttgatccgtatccgtggttccatattctccagcaaacacattccaaccttgatttgcatattgtccaaaatcaccaaatgttaatttcgaacctgcgcgtgcatcccctatccgaccatatatctgcatagaggttacatttcctaagtcctcattattgtcttttaaaaggcctgcttgtactcgtccatttgaaagaacccggagttgagcatttgcgtttgatactaaactaattaaaattaagaaagaaaaaagtcttgttgttttcatataagttgttctaaaatataaatagataaacattcaaataatacttctaaggaacccagtaccatatccaaacaattgcgtaaaagaggctattacggatagcgatcctacacgtaaatcacatttattgcggaacattgcgtctacaaacaataaaagggcataaataataagaggcaccagaaacaagcggcaaaagaatgagccgataaccaatagacagactgaaaacgtgaataatgccggtaagcaatgtaccagcttcaatgagccgggatgtttccggttcaacgcgatccgggcctcccccgaatgacgtacctgacggaagaactgcgtgagatccgtccgccttttatgataaacccatgctgaaggaaatagccgggtccgataaccagcctccatgatccgtatgctaaaatcaatgtcctcaccatatcgcatgccggaaaaaccgcccagacgctcatatacatcccgccttattcccatattaaaactacggggataaaatttatccaactttttcttcccgccgcggataccaccggtcgtcaggaatgaggtcatggcgtaattgatcgccttctggatcggggaaaacgaggcatgcgccttatccgggccaccgaacgcatccaccggataatgattcaacgattcgtgtatatgctcaagccacgtggagggtagtaccacgtcagaatccagtatgagcagatactcgccacgcgcttgcctagcgccatgattacgcgccatacccgggccggagttcgagatcacataataatgaagatccaaccgcccttggtatcgcccaacaatctctttcgccggtatctccgaaccatcctccaccacgataacctcaaaatggacataggtttgcttgcaaaggcttgataacagatcatcaagctcatccggcctgttataaacaggaattataatggagtataatcgcatatcttttgtataaaaaagattgaggataccctcaacagacagtatcactcaatcttatcaaaaaaactatagcttcaatagaaataaatattattgtaccaatagcatacgtttcgttgagatcaactgtccgtctactaccaaagaatacatatacatacctgcgacacctagatcagaaaagcttaccattatactaccttctccccgggtagcgatatcgaatttcttaacttgagttccttgcaaattgcaaatagagataaaagcagaacgtgcggatgtagggatcgtaaaggatatattcgtggtagaattaaacggattcggcgtattttgattcattaccgcattcgagagcaaagacttactcgtcaaattcttgttattctgcaaatcagacaaattagctttttcatccaattgcaattccagttgttggatagtagcgtccaattcttttacagcctgtactaaaacgggtataacagccgtgtaatccaccaagctatcacctgtggaacttaacgtcacaatctctggcataacctcagctacctcctgtgccaagaaaccaaaagctttagaaggtacggcttctgctgatctcaattgcgatgtctcacttttccaattgtaagataccggttttaaccccaatatggttcctaatccactatttaagggagtgatattggttttcaaccgagcatccgaagattgataaaccccctttacttctatataattatactgggagctttctgaatcatagaaaacgacctttcctcctgttcctgagatacgaggattagcgaccgcaacttttaatttcaagaatgtacccggataatcactcccgttataatacaatttttgtccccacgtttgtatgttcgtgtactgggcttggacactaaacgatacgaataggcatagtatgcctaataaagatacagatcttttcatgatttaaagatttaagttgataatatctattttaacacatcaaaatatccaatcaaataattatttccttttgatataaatatcttataatcaccattcagcaaaaaatctatagaaataggatattctatctcagaagaaacagttatgatgtcattataaagtacatttccttttatatttataattttcacattaagtccatccaataatttattagaatggatgtaaatattattttcatctattgataatgtaggagaagatattatagaacgatcttcctcttcttcccaagattgttcagtatccttcactctattcggatacacaactgaagaaacaaacatcagaaatactaatcccaatataaaacttctctttttcattatctatttttataaacaaaaatagtctctatgagaaatctataagcaaaataggatttacttcttatttactttttgtttacagcgattaagttattataaatcagcgataaatttatccatcatttctgcggtaccttctgttccatgaatctttttatagagacgaatccgggatgctgttattgcaggagttgagcgtccaactaaccttgcaatgtccttcacaggcatggatatttttatcaaataacaaatatggagttctaactctgagatttgcgggtataaagcatataattgagcggtgaaatttgaataggttgtatcaatctcttttctcaactccttccaatccttattctgaatttccgtatcagtattattacttgtttcatgaaataaccgatagacttcggattttcgaaaagctatttcaagcaaacttttttcattttgagaagtaagaatctttcggtttgatagttctaataattccttttgagattgcacaagttgctttttaaaattatctctttgacactccgattgctgcaaaagttcctctagatatgaaattttcttattattatattcaatacaatccaaactttccgcatattgattctctttcaatagacgtatttttttctccttttcaatcgctgcttttttcttcttttctaacacatatatataacatagactaaagaaaataattaaaacaacaaataatgcaaattgataattgcgaatttttcttttttcattatctattttcaattgaacattctccttttctgtatgctgatacttatataatgagttaacttttgctacagcttccgtttttgtttgattcttaattgaatcagacagttctatacatttatacgcataattcaaggctaatttacggtctccttcttggttttttattttagataagattctatacgtattttttttcatatagatattcccatactcatttgctttctcaaaataatatagagctgaatctatttgcttatagctttcatatatacaacctaatccaaaatatatatttgcttgattcttcatacttgaaaccttactgaacaaatctttagccaaatcatattttcccatatctatatagatgctactcaattcccttagtacattatctattctcgattgatcatttaataacaatgccttctcataagcagattgatagtagtatatagcactgtctgtatcttgcttggcgttatagatccgagcaatattcctcaatgcgatcacctctccttttcctttatcatacatcttgtattcatacgatttcctataagcttcgagagcctcatcatacaaaccttgatatgccagtcgatatcccatctgctcataaacccgtcctaatatatcatatcgcttactatctttccctatgtccgcagcatcttgaaaagctctcaccgctcttggggcatctcccatatcccggtatgtacttcctagataataatatgcctccattaattgatctggagtcccatagtcctcataatactgaactattgatttaatcaaagagtctgattcatgaggaatatacagcttatctttagctttaatcttaagcaaagcatggtacatacgtatattttccggctcattcatgattgagctatccaaagaggaaagacagagtaatgcgctatccggatgctcccacataacagattccgcacgagataattccgctggtaatggtttttcttggcgcatacaagaaaaaagggtagcgaaaagtagcaaagtcagtcctagtgttctcttcatttagattacagtttacaacttaaacgcaagttataaaatttattttataaataccactaaaatatttgtttttcaatagtgattttgagatacgatcagccagcagggagatgcggcacactacgtatccactagttgtattatgtatttaaaatattagcatataagcatttgcagttttttatggtaaaaaacaaaagtttatcaagcagaaaacttttgtttccatatatagaaactaaagtttcttcagcacgaaacttttgttttccctaatagaaactacttttacatatataggcactacgacacacgaacctaaacgataatttggtttcttgcgttttctatcaaaacatggtagataaagaatgataattgtagatattttctatctacaaccactatataagatgtttatttataaggcatataagaaggaattgtagatgtggtagatattaagtgttttttattaactggtaatttatggaactcgattatataatccaacaagttcttgtaactttgcagccattttaattgaaatcccgattgaatatgaagaacaaatacgaggctaggctaggtacggaacgtatgctaccgctggttttcaaaatggcgcttccggcggtagcggcccaatttgtcaacctactttacaatatcgtagatcgtatctatatcgggcatattcccgagatcgggacaaacgctttggccggtataggggtgaccacctccatcgtgatcttgatctcttctttctccgctatcgtgggagcgggcggttcgccgttagcggctatcgctctcgggcagggcgaccgggaacgggccggaaaaatagtgggaaatggatttatattgcttatcctatttactatattcacttccctcatcacctataccttcatggaaccgatcctgctttttacaggagcatcaaaatatacgttaggatatgcggtggattatctctctatttatttactgggcactctgtttgtcgagatatccacgggcttgaatgcctttatcaacgcgcaagggcgtccgtctatcgctatgtgctcggttttgatcggggctttattgaatatcgtattagaccctatcttcattttctggttggatatgggggtaaaaggcgccgcgctcgccacgatcctatcgcaagcttgcagtgccatatgggtattgagcttccttttctcaagacgtgcctccttgcctttggaaaggcggtatatgagactggaccgaagaatcgtactctcgatgttcgctttgggaatttctccgttcatcatggccagtacggagagtctggtgggtttcgtcttgaatagtagtttgaaaaattttggcgatatctatgtgagcgcattggctatcttacagagtgccatgcaattcgctagcgtaccgctgaccggtttcgcccaaggattcgtaccgatcataagctataattacggacatggagacaaacagcgggtaaaagattgttttcgtatcgtgctaatcgttatgttctctttcaacttgatactcatgctattcatgatcttattcccctcaaccgtagcctccgcttttacaagcgacgaggagttgatcgataccgtccgttgggtcatgcccatcttcttggcgggtatgacgatttttggcttacaacgagcttgccagaatatgttcgtagcgttgggacaagctaagatatctatctttatcgccttgcttcgtaaagtaatcctcttgattcctttggcattactattacctcattttatgggggtaaccggcgtatacgcggcagaagccgtatcggatgccacggccgctatttgctgtacgttgttatttatatggaaattcccgaagatactagggaaaatcaagaaaaaagaagaaagggctgcccaataacggacagccccctgataaagccttaaagattaaaatgaatcgtattaatatcccggattctgtgtcaagttaggattcaggctaaggatatcggcatagatggagaataccgttgtatatcccgtcttatcctcttgataatccagcgagctggcggaatgtttcacgcctacatagcggtctaccgtagcctcggtaaacttgccgaaacggatcaaatcctgccggcgtacgccttcccaagctaattcaagcatacgctcgtctaatagcgtatccagcgttacgttttgtagcggtttggcgcctacacggttacgaacttggttcacctcatcgtctccattctgtcccagacgaatcttggcttccgccttcatcagcaacgcgtcggcgaaacggaagatcacgcagtcatttccatgcaagtttccaccatcctgagcattctggtcgaactcatatttagccatacgagctccggcggtcttcaccaacaaaccatcggaggcatccatatataccttcggggcgttcggctcatatttcaaaggaactttctgtccgtcccattccgtatagatcgtctttccgtccggaccggttacctcgcccgtaaaataagtaagcttacaacgaggatcctcatccgccgtaccgaacttaaacacgttcatcgccttcaccgtagcgcaagagccattccatccggattggccgtaagcggttgcatgatcataatggcgggtacgtaccaaattgtagtcctttgcgtccggataagcgaccgggtccataggaaccgtgaaaatattctcaaccgaggtctcgttcgctacggcgaaattctccgagaagtttccctgcaatttatagcccaaagcctccagcttatccacataggcgatcgtagcttcccaagcgttcatctctttaccgccaacggtaaacttgatgttctttccatccggacgattgccgtccgtccaattgtcgtccgcataaacctccgcgttcaacgccaacttagccaagatcatataagccaccggcttggtaatacgcccgtaatactcgcccttttggttactgcggttatctgaaagataaggcaacgcctcctccaactccgaacggacaaagttaaatacaacgctacgctcagattgctttacctcagacatcggtgtcgtagaggaagttaccaacggaacacgagcgaacaaatccaacaactcataatagaaaaacgcacggaccgcacggacctcttccagataaaccttgaaatattccacgtccggttgttcctcggcaaaggcttgcaacttatcaacactctggttgcattttccaatctgctcatacaagaaatcccaagagttcttggtcaaatcattcatcgtgccccaacggtgtaagaaaatattctgccataaaccgccatcttcccagtcgccaatacggcaaggaagcatagcctcatcgctggagaaagtattcaagtcatatacatgacggtcgttacccatgatcttgaacatattattgtacaggctcgcaaccgtgtttacatagaccaacgtagggctttggaacgcggtctcctcatcaaacgcatccgtaggacgctcttccaaaaaattagaacaggaagaaaatgccgcggcggcagcggctatcataaagctatatataaatttctttttcatgactctttaaatggatttagaagttaacactcaaacctaatgaatacgtacgggataacggatagaaacgtttgttatccatacctaggtcattattatctttatcgaccgtcgtactgttaatcatcggagacaaaccggagtaacccgtgatcgtagctacgttgttcaccgagaatgtcacacggatattcttcacgtatttctcgatcttcttgcaatcgatgttgtaacccaacgtaatataatcgatattcaaataattacccttctccaaccaataatcggagatcgactggtcgtagatcttgctttccggagcctcagccaacgcgttgtatgtagggaactgactcaggttcatataagctagcgatgtaccattgaagatcttatgaccgaaagcgccgttcatctgcgtcatcaagtcgaagcgtttgtagcggaagctgaagttcattcccagataatatttcggcatggcttgtccggcgatataacggtcgccaccatcattggtatccaaaccctcttttccatcgatcgtctgatccaagttatagacataacggccttcgatagcgtttccattctcatccaaagccggagtcaagcccaagcaacgaggaatgtagaacactccgacaggctggcctaccatctgataaaccacacggttgtttcctacgaaaccggcaccactcatactggacagatccatatattgtttcgcctgcaactcttgtcccatataagaaccgctcaaggagttcaatttattcttctggtaagagaaattcacgcccatgttgaaatcgaagtcctttgtcttcacgataccaccgcttacagccaattccacgccggagttggtcatctctcccaagttcgccaataattccggatatacgaacggaggaaccggaaccgcgtatttatacaacagatccgtagtcttggaagtataccaatcggcggtcaacgtaaagcggccatcgaggataccagcgtccacacccacatcgaatgtctttttcacctcccaacgcaagtccgggttcgagttacgtgtaaagccataggtagcggtagaatttccattgacggaagtcacaccgttcgggctcatcaaagccaacgagttataagcctcgatagcatcttggttaccagtcagaccataacccgcacgtagtttcaactggctcagccaatccacgtctttcaagaaagcctcctcattcaacacccaagcggcggaagcggaagggaagaagccccatttattattcatacccaatttagaggaaccgtccgcacgtaagttcacggtggcgataaaacggttgtcatacatataattgaaacgacccatgaatgaggccagacgattctcgttttggaaagaagtcacgtctccgtatttcactgtaccacccgctttcaggttgttataaccgaagtaatccgtctcaaagccacgggcaccggcgctaaatcccgtataatgatatttttgtcccctctcccagacaataaatggattcaatcgttacgctgctatttctcggtaaataatgtatttacacttaccggatataccggaggcgatcccgctaatatcaacgtgaatggcgtagaacccggtatcgagaccacttccatctatcctgtagcccgtaccttcacgctgggattatccgtccaattctaaagacctccactgcaagccgggttgcagtaacacaacccgcaaggctctatccggaaaacctgtagtctatatttattttgtacgaaaagcaagcgcaaaaggaacaacctaatcagttaatccctaactttgtgagcctaaacagtagaaaacatggtacaaagattcgattacttagtgataggctcaggaatcgccggtatgagtttcgctctgaaagtagccaatgaaggcaagagcgtagcacttatctgtaaagccggacaagaagaagccaacacatatttcgcgcaaggaggtatcgcttccgtaaccaacttgaaagtagataatttcgagaagcacatagaagacacgatgatcgccggcgactggatcagtgaccgggcagccgtggagaaagtcgtgcgcgaggcccctgcccagatcgaggcgcttatccgatggggagttaatttcgataagaaagaaagcggagaattcgatctgcataaagaaggaggacactccgagtttcgtatcctgcaccatgccgacaatacaggagccgagatacagacgagcttgatagaaacggtaaacaaccatcccaacatcgccgtattcacgaaccattatgcggtagagattatcacccagcaccatatggacattatcgtcacccgccatacccccggtatcaaatgtttcggtgcctatgtattgaacgaggatacgggcgaggtacatactttcttgtcaaagataaccgttatggcgacaggcggttgcgaggccgtttaccggaatacgacaaacccgctggtagctaccggagacggtatcgccatggtttaccgtgcgaaaggctccgtaaaagatatggagttcatccagttccacccgaccgccttgtatcatccgggcgaccgtccctctttcctcatcaccgaggcgatgcgcggatatggagctgtattgagaaaccttggcggagaggagttcatgcataaatatgatccccgtctttccttggctccccgtgatatcgtagcccgtgcgatcgatagcgagatgaaacaacggggtgaagaccatgtctatttggacgtgacgcacaaagatccggaagagacgaagaaacatttccccaatatctataaaaaatgcctcagcttagggatcgatatcacgaaagattacatcccggtagcccctgccgcccattatttatgcggaggtatcaaggtagacttaaacgggcaatccagcatccgccggctatacgcaatcggagaatgttcttgtaccggcttgcacggtggtaaccgattggcctcaaactcattgatcgaggcagttgtatatgccgatgccgcggcgaaacactcattaagcgtcatggatcgctatgagttcaaccaggatgtaccggaatggaacgatgagggaacgatcaccaatgaagagcgtgtattgatcacccaaagcatgaaagaggtaaaccagatcatggaagcgtatgtaggtatcgttcgtagtaacacacgtttgatccgtgcgtggaaccgtttggatattttatatgaggagacagagagccttttcaaacgttgtaaggcatcccgtgaattatgtgagttgcgtaatatgatcaatgtaggttatttgatcactcgtcaagcgatggaacggaaagagagccggggattacattatacgattgattacccaccgattaaataattgaaaattgagaattgagaattactagctatgttaattctcaattctcaacttttaattatcaatagttctgtttcatcggttcaaagtaagcttgcggatgagcgcatgccggacaattaaccggagccttcttaccctcgaatacgaaaccacagttacggcattgccagaagatagcctcatctttctcgaatactttaccttcctctacgttagccaacaatttacgataacgtttctcgtgttcagcctctacctttgcgatcatcttgaaagctacggcaatagcgggaaaaccttcttcctccgcaatcttagcgaactcaggatacaattcagcccactcctcattctcaccagctgctgcggctgccaagttctcagcggttgttccgattacgcctgcaggataagaagcggtaatctcaaccattccaccttccaagaatttaaagaaacgtttagcgtgttccttctcttgctcggctgtttccatgaaaacacctgcgatttgctcgtaaccttctttcttggctacgctagcgaaaaatgtgtaacgacttcttgcctgagattctccggcgaatgatttcaataaattctgctcggtacgtgtacctttaatacttttttccataatgctaattttatgtagtaaattaatgagtctgttttgtatatcgtttttctcatgaccgatcaaaagtaagaatttgtttccagatatcgattacgcaaacattaaataatatctatctctcaatagatatcacttatttatcaaggaaaaacttctcctcctttatacaatgaaacaacaaatcctcctaaattgtttacacaaaaccggaatgcgtctttagattttttgcatcttctttattttattaactttgcatcctcaaatcaaacaggcaagaagaaaaatgaagaacaaatttgattttcagcccaaactctttacggcgctgagaaattattccaaagagagattcatgacggatctcatggcgggtataattgtcggcatagttgccctaccactcgccatcgcttttggtatcgcctccggggtaagtccggagaaaggattgatcacggctattatcggtggattcattgtctcccttttaggaggctgcaacgtacagatcggcggacctaccggagcgtttatcgtgatcgtttatggcattatacagaacttcggtatcgaagggcttgccatcgctaccgtcatagcgggtattattctggtattgatgggcgtgctgaagctcggtaccgtgattaagtttatcccctacccgattgtcgtaggtttcacgagtggtatcgctatcactatcttcacgacacaaatgaaagacttatttggattgactatggataaagtccccgccgatttcatctctaaatggatcgcatatttcggggcgttcgatacggttaacccttgggcattcgttatcggtatcattagtatcctgatcattacgttaagcccgaggctaacgaagaaaattccgggttccttgatcgctatcgtcatcatgacgatcgttgtttacattatgcgtaatcatttgggtattacaggtatcgagacgattggagatcggtttactattaacgcttccttgccagccccggctccgatcacgtttaatatggagacaatcaacttattgcttccctccgcctttacgatcgctatccttggggctatcgagtctttattatccgctacggtagcggatggtgtgacaggcgacaagcataattcaaatacggaactaatcgcccaaggtgcggcgaatatcatcgttcctatttttggcggtattcccgtgaccggcgccatcgcccgtacaatgactaatataaataatggtggacgaactccggttgccggtattattcacgccatcgtattattattgattttgcttttcctcggaccgcttaccaaacacattccaatggcttgtctggctggcgtattgatcatcgtatcctataatatgagtgagtggcgtacgttccgttccttgatgaaaaacccgaaaagcgacgtatccgtcttgttggtgactttcttcctgacggttatctttgatcttacgatcgctatcgagatcggccttctgatcgccatgttattttttatgcgccgtgtggctgagaccacgcatgtatccgtcaccacggatgagatcgatctttccgacgagggcgagattcatcatgacgaggaagtcctctccctgcctaaaggtgtagaggtatacgagatcgatggtccgttctttttcggcgtagcgaataagttcgacggcatcatgaaaagtatgggagataaaccgaaagtccgcatcatccgtatgcgtaaggtttcgttcatagattctaccggtctgcataacttggaaagtcttttccgtctttccgaggcagagcatatccatatgatactttccggggtcaatgaacatgtacaccgtgtattgacaaaatccggattcgataagaagattggcgcagaaaatatttgcagtaatatcaatgaggcggtagagaaagcgaaagctgccgtacaagactaagatactatcagacagtgggagacgcagcatgctgcgtctctacaactggatatttattccggtaaataataccagtcctctggtaagacagcttcctttattttacggctggaaaccccgacctccaaggcctcgcccatataatcctcgaaatacaaaacacgtaattcgtggaaaccagcgtctaacgctacctttcctttcgctatacgagcattatgagagccatcattatcaacaatagctttaccgtctataaatagcttggaaccatcatccgaatacgtataaaagcgatatacacctttttcagggatatttatcaacgtacggaactcataagcgaaatgatccttggccggagcctcctgaatggagatatttttcatcgtaccctctttcacttttgtcccggaagcgatctgatccgtatgtttaaacttgccttcataataggtataagctaccccgtgctttttaggttttaccgttttggcgggtaagaattccatcgtttcctcatccttagaggtcaggccagacggataataatacgtatattcctttccggacgaggtacgaatccatgaatcaaactcaaacttgccctcacgcaattcaatgatacggccaccccgctcgaaatctccataagcgtcccatccggatacacgcccgaaagctagtcccacgttatataacattcctatataatcattatcatgatcgtgcccggcaaaagtagccatcacatccttcatttccaccaaggaagcgaagaagcccgtgttgatcttgggagaggcgattccctcttctttctgtcctaatgtagtctccgccccaacgatctcattatattccagcaaaggaatatgaaaaaaggccaaggctggcaacggtttgccaccattttccttggtatagcgcatactttgctcacgataccaattgatctggtcgaaatgaatccaatcatacgtaccgtaatcttttagcgtaggataatcgttggagtcgatacaatacaataaggccgccggtttctttccgtctgaactgtagaccggtaccacatagtttccggctccatgaatatcacccggtcccttctcacccataaaataaggtgattgactgagtagggcataaatctcgtccttgggaacgatctctgcgtcatgatttcccatcatcaccgtaaacggtatcttggcctcctcaaagatcccgatcactgacttccatccttccaaaccgggatttgctgtcaccacgtcgcccgtcagcatcgccacatccggattttccgcctttaatacggattgtatcgtagcgactgtcttagcgcatttagatgatttctgatcccaatgaatgtctgtaaattggacgatcttgaatttcccatccttgaaagcaagctgtttttgtgcgaataagctcatcggggcacaaaagcacaacaaggctatcgctaataaaaaagtctttttcatgttcttcgatttagtaattgggggctaagttataaaaaaaagagagcgatgtataaaaacaggctctcttccttatgttaaatgccacaatgaaacccttgctgtcaaacaaaagctatatacatatccgcaagccgggttttcctgtcaaaatgcgggatatcttttactattttctcacaatcctcaaggctcattcctcctttaggttccccccagtaccaaagtttaggggtattctgttttttacttgttgactccataattctcgttgtttttatcgtaagacaggaaacgctcaaatacccctatcctcaaaatatataaaagattaaaataatgtgaatttatatccaaccgacaaccccaatttcaaatcccggtcattgacacaattctggaaatagttcactcccacataaaatctttttacctctataccggccgccgccgtagctcccagattccaatattcaccactaccggtgtaagcacccgcatttaatcggagattcactttatcgctcaacggaatatgaaaagaagcatacacgggtacaaaaaaatcaatattccaatcatctccatatgaaaacgaattccctgcggtatgcagcaacaatcccgtttgtatagaaaacaaccgtgattgtggaaagtttatatacgcccccgtctgaagcccccatccatctcctcctagtattccggtacgagcttctatatcagcggcctgcgatcgaccaaaagataaaagcaatattaacagaacaaacaacttcttcattacttacaaggtattaatttaatatttagattgaataaaagttcgacatatcatgatatagaactcccattcaatctaaatattgcttctatatcattattcggctccaagttagtgtattccgaatatagcatcttttatgacgatcgaatcttccgaattctctatattatataggatgccttccatcttcccttcaatataaggggtaccacttccctcatgaaaacgaatactatccacttgtatccgaaatgaagatttcagtggatgatacactattttagcgtcatctttcgtgatcctaacagtagattctatctcttcattcaataatttacccttatcgatcagatattctccttctctcaatggaatcaatgagatcctcagcataggataaggatagtcagagatatgcactcctaatggtatctcccaatagaaaccgcttaaatcggtatttacctcctgccaaaaatttccatgatcaataaaagaatgagagttcgactgattagctatagaaatatcttgactattcacctttccttcaaagtaccccaaatagtaaggagtttcttcaaaagaaatatcttcacctttattacaagatatagacaaaaataataacatactaaataaaaaatagattacctgtttcatattacaataattttatataaatataattcttatttatcaattacatactttaacagaatcagttcgtacattctatcttaaatatagatattatttttaagattatctctacatattacagtcaaaaaaatatcaaaccacaaaaattaattatattttaatggacttagtgctaattgataccatccagtcctatatttatctgtatagtcaggtttccaatcccttccagttgataaattcttctttgattttaggattttatcttcaaaattaacaataacttgacctaattcatcactagctaaacttttagtaactgtatatgaaactgtttttgatgtagttgctgtagctccaaattttaaaccaatctttactttttctccaaaagatggatcaaatccaaaattagttgcaaatgtagctgttgaagattctacactttgaatagtttcactaatatctagttcttctatcgctatttttattattgcaccataattctctatattccattcgaataatggaaggtccaaagctattccatctgttaactctattgatttaacttcgaatttactactaagcggatcttttggtgttattttaaacaatgcagatggtttaactataaaattgttaatatattcattacctataccagcttgatttgcaacatacacttttactataaattcaagtgatccgtctgtccatggtgtaagaatagtactacctccgggacgaccacctcctgtttcttgatgagtatttccatcaattctaggatcttcactttgatcacaaattttgttcataactgtacgtggatctcctaataatttaaaatacaccaaactttccttaaaatctcgattgaaaggtccttttggctgttgaggagtcaagccataatatatataatctctcggccattcatttgttgcagcaaatacgtcgtaggcttcataaacctttttcatattttcaggtattgatcctgtgcgatctctagtatcaccactagaaaaatttctattctgtatgactgaagaagcattctctgtattatcaaatacatcactaaagaatacaatatcaggatttataatactcatcggtgacaaattcctttgagccttatttacagaaaccactctttcatttaacttcactactacaataggatatttaggaatttcatttgatggtattaagaattctttatttactccatagcccattacatcattactatttttaactcttaaagctgtatatggaacttcactctccacattccaaagttcagcagaaaaactgttatcaggcaattctggtacaaatatagttaaggttgaaaataattgttttattttttctaatctagttatatccatatacaagctcattaattcatcaaccgtttttccagaagttaatctataagaattaatagataaatataatacatcataatcataatcaaacatctttaaagcttcatttttaataatacgccttaattctattgaagaatctaaactataagctaatgccttactaaattcttctaataattcatgatttgttattgtatcattactaacagtggtaatattacggcttacttcatttcttggtaaactataatctatttcctctacacaagacattaataataatactgataaggaaaacattattttaattatttttttcataataactattatttataattaatattttaattaataaaatctatagaaataagaatccatatacattgttataaccatctgttatttgcaacacacctttttcttgatcttttaaaggtattactaaagatggcatagtactcgtttgtaccatttcattatagatcacttctcccgtagaactagtaacgataacacgcacattacctacattttcatagaagttcactatcagttctccactagcttcttcaatagaagcgtccataggcaaatctacgagaatagatttttttgaatgcttccagttaccatctaagtgaacccgcctaccaaaacagggaatagcacttaacaaagccattactacaaataaaaatttaaataatttcatttctcatctcattttttgatttggatgcgaagaacaggctaatagctcgaataacaaagaaaaagggctaataagtgacggacaaactcaatttataatttactgataattaataaattataaattcatggataggacaaacatttcatggatatatacatatatctatctaataaacaaaaagttacatcatattaataatataggtatacaaatctagctcctcccctataattcctagcttctgacgtacacgttggcgacgcttatttacagaatccggctgaatgtttaatagaatagcctcactgatcgtatctaaatgaaataaaactaaataacaatagcgtaaatccgcaagagtcatattgaactcagagaatttcttttctaaagatgggtagacctcatttgcttgagtaataatatttcgccaatatttttctgaaagaggggattttgtcgtaccaggaattactttttgggatagtttaatcactttccttgctatcatagatgataaaaacagattattacgctgttctgcgattctctggataatggatttttcttcttgtttcgttcgttcatatcgctcctctaacttcgctctagaataagatatattgagcaattcatctttttttgataacttatcgaataaatcctgaagctcacgttgttttatattcaagctattctgcagtttcaataattcaatattcttttgctcaatatcgatttgctggacatatattctcttatttttcttattcatttgcaactgataaacgaataacaataatagacaaacagtaatagaagtaacaagaagtataaaagtccattgtttatccatctttaattgggtattttctaacgatatttttaaatgattatacgctttttctgtctttacgatattcgctttattttgtaatgctaagatagaatctgcggcttcattatattgctctaaataggttaaagcattttctatattaccttctgctttttccagttcataataattataaattatggagatatgcgtattttcatttagggttggtatgatgttcgcttgctctaaacataggcgagcattcttgaaatctccttcttctatatagacaccggctaaagcggaatagtctggagcattatccaattcagaaacatttattgatttccataagtattgcttagcgagttctatattgcctaacacactataaacatttcctatcccattggatatatatcctatatcagaagaatcccctagttccgctataatagtatcagcttctagcaaatatctcaacccgacctctgacgaatccgcaaaaacatacatacgtcccacatctcgcaaagcgaaagctgcgctccgcatatttccgacctttcgaaagtactgttccgcttttttatatttatcttttcctaataaataatcaccgtcaaaatgatacaagtctcccatatagctacaaatatacccggcttgattatagtcttgacaacgtaaagcgatatccaacgcctgtaaataagccttcatagccagctcgttatccttatcctccacatacgaacgccccaagtacaaaccgatcctcgcttgctcctgccccgttccgtgcgactcgtaataggcttgcgcacgccgcaattgctgtacgtagggcagatccgtatataacgtgtccgccactttaccggatagcatacaccaacgagccaataatttatcgctcaaattatcgggcacggctatgctatccaataggataagggaactatccggatcagatttcaacaaggattccgcacgatcgattaggtatgtagcctcgctctcatctttacaacctataaaagagagcgtggataatagtaatatcagaataagcaaatgcctcatcggttcctatctttagattctatgcgcaagataggcatattttttatcaaaccttaaagaataattgattattaggcttattgtataaaattattatcgcttggatatctccatcatcttttggaaaaacacgtacgtgttttcataaattctcgtacgtgtttccgaaaaaagatgtacgtgtttttcctaaaacatgtacatctttttatacatctgattttcaatatactaaaaacagtattcccaaaggcagggatattgtaggaaattccattatctttggactttcattggtaactttttaatctactatcaatatggcacaacaatccggaagattgctatccctcgacgtgatgaggggaattacgatcgcagggatgattttggtaaacaaccccgggtcatggaagtatgtatatacgcctttagagcatgcacgttggaacggcctcactcccaccgatttggtatttccgttctttatgttcatcatgggggtctccatgtttttctcacttcggaaatataacttcaagctgtccaaagagagcgtgacgaaagtattgagacgcacggtattgatattcctcgtgggattagggctgaatctgttcgggcatgtttgctacaatggatttaccgatttccagaatttacgtatccttggggtgatgcaaaggttggcgctggcatatggcttcggctcgttgataggattagcgattaatcataagtatattttgcaggtagccgctggtatattgatattttactgggcattactaggtttcacgcatagtatggaaatgtcggaggatagcattatagcgatcgtggacagaactttattcggtacatcgcatatgtatcacgatgatatggcagatggtacacggatcgcctttgatccggaagggctcttgagctgcattggtagcatagcgcatgtattacttggtttctacgtaggaaaggtaatacaggattgtaaaaagaacaatgagttgattatccgtaatatcttcattttcggtacgattattctttttgccggtttcttattgagttacggctgcccgatcaataagaaaatatggagtagtacgttcgtattggtaacttgcggattcgcctcgttattcctcgccttattaatctggatcatcgacataaacgggaagaagaaatggacgttattctttgagtcgttcggtatcaaccccttatatctgtatgtacaaggggatatattcgccgtattgctgggaatgagcggtatctccgcctttatgtatatggatctgttcaggccgatattcggcgatttcggaggctcattagcatgggctatcttcttcgtggtactaaactggataccggggtatttcttgtataagaagaagatttatatcaagttgtaaaaagaaatgatctatgctctgtatatagaacaaaaaatcactatatttgctctatatacaaagcataaatacaaaaatcaaattaataatttaactatggaaaatgaacttcaagttattggaacgaaagaagtagaggaacgtattattgagttaagaggacaaaaaatactactagatagagatgtagcagaattatataaaacagaaacaagggatataaacaaagccgtgagaaataatcctgaaaagttccccagtggttattttttcacattgaaaccctctgagaaacagtatgtggtggaaaatttccaccggatggaaaacttaaaaaaatcaacagtagaacctaaagctttcactgaaaaaggactttatatgctggctactatattaaaaagtccaagagccacacaaacaactatcgctataatagattctttcgtaaaactacgtgagcttatccgaaatgtagatgcgattcaaaatgaacctgacctaataaaacaaaaaggtattgtgaaacgaactggccaactcttatctgatctgttgatagatgatgctgatacaactgaaatggaatctaccatagagttgaatcttatggccgtaaaacttaaacatacagtaaaacgtattaaaaataacaataaaaccgaagataaatctgaaatttagaattgcaaaaaaaatccaaccactctcctattcatatcggagaatggttggattttttataggtatcagcctagctgactagttcacgttataaccggagataaccaccttcggggtctcgcctctcgtatctacatctttccaatggatgttgatctctttcttctcgcccggaagcaaggagaaatagttgtcgctatagaacatcgggaggaattgctcgccatccttctcgcccactacattcacacggatcatcagagccggggtggatgaagtattctctaaggtagcggtagcggtccaagtaccgtcattacccttattggttgccacgttggatcgtaaagtaacctttggcatctcacgcaaagcttggtagttgccttcctctacgccacgcagatagaagttatccgatacgatcttgccattctctgtcaacgtcaacttgacgaaatgagcgctggatacgctagctgggaaatccagtttcatacatttgttggtagtatcttctttactatccacggaaacctcgttttcccatgaaatagaaccgtccatattgatgatttgagcctttgccgtcaaaccattacgtacgccggcgctatagttcactacctcgatctcgtccgtaaccggattccattgaatgtgcagaggctcggaggccttcttgcaaccaaagtaagcggcggtaggctcgaaataataatcgtaagtctgccataccatagaaggccatgccggatgcgtcatccacagcaataatcccttacggttcaagcttcttgattcgaacataccccggtaaccatcatagtttacccactgagccagatcggcgaattccttggcgttgttcggcttaccgaagcccttttcgatgatagcgttgaaagaagcgcaagactgggcgccttccatcgtataatcgtgttgtccccattgagcgttttgcggccaaagcgcttccggagagaaagtacgaaccaagctctcgtaattcatcacgttgggcataccccgctcactatggaacttatcactaccattcttcaagctaaagtattctttaacaggaagcgcacggtacgggccatggccacttaccacctcatccgccgagctggagatataatgtaagcccggatgatcctctttcacgatacggcgtaaagccttgtcgatctgctccggcgggaagccctcgttgcgcccgcaataaataccgatagaggcatggttacggaaacgtttcacataatcctcagcattggcgataaacatctccggatcataaggatcgggtccgtcggaaggattcgccaaccagaaatcttgccagatcatgataccatgacggtcgcaagcctcatacaattccttgtcgccgatttgtcctacccagttacgcatcatcgtaaagttcatatcagcatggtaagccacggcgatgtcgtactcacgaccccggtaattcaggttagactcaccgaatccccagttaccgccacggccgataaaacgacgcccgttgataaagagactcaagatgctattattctcgttgaaggtcatttgtcggatacctaccttgaaatcctcagagtcggataccttatcgcctaccttaaaggtgaaattagcgtcgtataaataaggagatccgtaccctttaggccaccacagacgtgggttctgaaccttcaattggctgaagctatttggatcgaaagtaaccgtcttctcctcgtttgcggccaattctaccggttgctcgaaagtgatatcgccgatcttccctgtcaatacaccctttacaggagcagcatcatggttcttcacgatcacttccggagtcaaggtagcggaagtcgtatccggcaacggtaatacaacctgtacgaacgggtcttgaatcgttaccttgcctgtagaagtcaagtacacatcatcccaaatacctatattacgaccacggatcgtcgagatccaatcccaaccgatcgaagcgtggaaggttgggttatcagcgcctaagataccaccgttgaaatccgtattcttctcacatttctccttgatagcaccgatatgctcattcttgatgatctccactgcgacaacgttcttacccggtacgaccctgtctgtaacgtcaaatacacctcggataaacgctccctcgatacggccgatcttgttaccgtttaaatatacattcgctttccagttgataccatcgaaattcaagaacaaacgatcttgcttgaatccttcgggtacctcaaactcatccctataccagaaattagagttgaagaatgactcggatatctgcatcaggttatccgcgtaattcggattcgggatagctccgatattcttataactactcaataccgttcccggcacagtcgccacgatccaattttccggagagaaagaaggtttcgatatttcctcgccggaagcggttacctcggaagctcgttgtactttccagtttccgcccgataaacggatctcgtcttttgtagcagccggagcagcagccggttgggcaagcaagccacctttacccatcacctctatctcgcttaagatatagcgtccgtcattagccggttgctccatccatacccgtacgtagcggccttttccttttagcttgatctcatccagattagcatctccacccggaagattcgctatgtcaacccattgtttagcgtcgtcggaaacttgaatcttacccttgatcgctttattgatccaatgtaattttactttgtcgaattcggattggctacccaagtccacatagacccactcctctcctgtcgtggcactcatccaagcgctattaaagaatttggaaggaagcaaatctatcaacttatcttggttatagaaattcatctcgaagaatgcccaataagcggcaccttccattttcaatcgcatccgataataagcatattcacccggttgatcgaatgtcaaagtctcattcaacatacgggtgggcaacgtacccggatcccagctattcttgttcgggtctgaatgggccttatacttgctggccttacccggcatacctttaccctttaaggcagccaattccgtccaagtatttccatcattcgatccctcgcaaacaatctcatatccatccttaatattattctcatcataagccacgctgccgcggaattgtaccttgtcggctttctctttccagttattcagcgtgaacaggaaataggcatcctcgcctgtaaccgcattacgagaataaggaccttgatcgatcatccactcacgctcacgacgagctatatccccattttgcgtggagagatcgagatactgaggttgtttatcgctaataacaccatccgtcaccagttgagccgttagattgtaatcataactggaggagttgtaagcgctacgcaaaagagctatgttacgatacgtggaataatccggacgtaatgaaggagaaaaatcctcccccggatctcccggatacgaaccgatacctctggtataataatccgaccgatcgaaagattccgccggaacaccgctctgcccacatcctcctagcaatgctgagaccgctaccgctccacaaagcgtcaagagtcgaggcaattttttctttttactgaatgttctcatactacttattgtgtttctctaaattagttagtttaataagataccgtcacgtcaaaaccctccttccgggcccgttctgcaatcgcatctaattcttctttagtagcttttttcaaagctttaaccggggtctccctatctatcgtataaatcatgacttgtttcggacggatttgttttaaggcggagatccagcccgctatctcctcttctgtcatattattaaccgatttcccattcacttcccccttcaagaacatggtctgtataatcaagtttccgttaaaacgacataattgctttaataaagactcgaaattaaacgccggagaattaggtacgtctatctgccgaatccgactgtctaatacagaatccagtttcaatatgttatcctctattttattcaaggcttgaaagacctcctctttctggagcatcgtagaattagaaagcacggcgattttagcatcagggaaaaatcgatcccgggtagcgatcgtatcatcaatgattccaccgaattccgggtgtatcgtaggctctccgtttccggcgaatgtaattacatccggagcgatcccttccgctttcatggaacttagtttttgctctaaggcttccctcacttccgtacgagtaggcagtttactatgggtcctatgattctcattcaatccacattcgcaataaatgcaattaaaagagcataatttcccgtctgtaggaagtaaattcatccctaaagagacacctagacgccgactatgtatcgggccaaatactattttatcaaaaagaattgtagacatagcgctgtttgtttttacccacgcaaatctactctaaaatttccagcgaagcaaagcataaagatctgttttatcagaaccgcttatctcctccgtatcagtacctatcaaatccctgtcccaataatgggtgtaagccagtttcgcagataaggataaacgtttccaaatatccagacgaaaggtaagggcaaaccgcatcccatccccataaaaagagggcatattaaaggcatacaatatattcttctcatacgaactgacccggctattgtaatcatccgtatgaaaccacgctagataaccatccatttgaagaggtagggtagtgggcttccagcctatactttgggagatcataattcctttattaagtttctttataggatcatcgaatagaataccatctaaggaagtcttaaaaataaaaggagaagaaaagttataaacctgttgaaaacgaatacgatgttgtttataagaattgattctcaataaattatcattttcaaaagttctattcttttctttttgccggtatttataacgaagataagctgaatagtttctactaggggtataatctatctgagccatatattcctgtcctccggaaggagcgtctatcccgtatttcaaccaaggaaaacggaataagtccgcataaatggataatttccagcgggcgatcggggttaattgcaatcccatataaaccccttgctcattctgaaccgtagagccttgcgagaaagcgttcccaaacaaagcttgataacggcgatcgtaatagcggtataataccaagaaagatatataagaagcgggtgttaactgcaaggcattcaaggtagaaatagctccgtttttcgaaagagcggtctcgccataaaacttaatacggttacttttcaacatatagtcaacaccgatgttgaaattgttggaacctctgaaatagaacaaattataaggttttggatcggggtccatcttaaacttaccgaatgaataggagagagccgttaaacctacatgaaaatgagatgtagcatagcggatatttcctccatatacctgcatcgttatcattttcctcttttcccaatcccgttgtaaacgatgaagtccatccgtttttaatgaggtgaatgtcaagctatctacggccgcatccatttttcggtacgaatagaaaacacttatatccaaatttttaatcgtgatcgtactagccacccctcggaagaaatcctgttcattggttgagaagtgcctacggaagccatttgtccttcgctccgcttgagcgactactgccgtacgactaggagaaaagtcattgctaatcaccagaccttgtccgaaagacatcttgtaatcccctatagccaagctttttaaccagttgatatcttttaggaatagatgtgcggaataaaagtcatatcctttatgatatgcgttccaaaaaggttcgcccgcatctttctcggctacgaagcctgcttgtaaacgatcctcgaaagtataggaataacgtaaggagtgatagaagggttctcctctatatttacgattcggatataacaaaagtatgctgtccgtttgttcaccatatccctttttctgttgaaaacattgatcatacctgatttgtaattcattacgaccatatttcaacaggttcttaaccgtaagcaaccgtttttcaacaagattatcacctatataaacaaatggaaggagaagagatatcgtctgaaaatcgatatcctctatattcttcaactcatagatgctaaccatatttccgtatcgtttccgataggagaggagctgctcaatttggcgatcggatagaaaaggtaatcgcttcagttgttcttccgtcacggcattcaaatcaaaaggatgctcaattaaataagataaatcggcatacaaactttcgatacgctccgtatcctcggtttccaaggctagttcctctacatactccatccacttatcaacagaatattctatttgagaattagcgtaataactatttatcaacagaattatcgacaagattataaacaatcgtttcatagctaagtatcatttaaaaagagaatgataaaccaagaccagtactcatccctaaaatcggatggtaaatagaggctacatctatcgtaaagcaagaaaagttataaccaattcctaaagagggcaggagaggagcggtctgtattccggcacgaataaaaaaagaatcgaaagcggtgtattcaagacctaagtttccaacaactaggttttcattttccgttcctgcacttcctgtaattaacagactgtttataatctcccattgaaaacttatttgaattaagtaataattaaaatcttctatttcaatatctttatctcctatagaaacagatggtaaattcattattaacattcctattaacaacttatcaataggagagaaagtgattccaaaatctgttgacagtctggatcttgtattttccaatagatcagtttgcaagaaactatagtgaactccaagccctaacgcccattgatcccccaagcgttttcctcccagcacacgaaccatcatctccctgtatttatcaaacccgaaaacagagatatcaacacctacggataatagttgattcggataataaaaactaccggacatcgtacccagttctttcaacatgtaccgattaaagtattctaaatgaatggactttttctctttatcgacaataagggccgaattgaataaaatagattgcgtcgccacattccctcccattcccacgctacggacatccggtaagcgtaagttatcaacaccatgtacatacaatgaaaatacccccgcaaacagggatagcaatagatatttcatagttaagattttgtatggtttctatttattcttcaaggttttctcattatccttatttactctacgctgtacctttttaatatcctcatccggggaaagttgttcaggcttaattcccctttgcaatagcatatcacgaacagcggtgttgttatcaatatgttctttctcaataggagattgtccatatagatccttcgtttgcacatttacgtttgtcatttccgccgctaggtctttagcttttatacttatagtcggtaaaaaatcagcgataggtctattcgtggggacgttcattctctttttcaacatctgtgtacttaaattgaataaggcttgatctcccttagaacggataatagcgaatcctttattatcaatgcctctttcgtataaaataccagatagttgcttttcagtctgacttaatttttctctagcctttaagcgttcacaatccaataggcgttgttcaatcacctcggccttacgggtttgtaccgcaaaataagtctgtgcaaaagctacttgcggtttacgactatcaccattttgtgcgattaagtagcatgcgtagcgtgttaataagatgtcatttatttgttgctcagcaccatgccccacaataatcactttcccgacgtcgggaaagtgatcctctatattttctcccgcattccggcacgcttctttggctttcaccactacattattgataaagttatcccatttggcatatcctaataggggttgcaactctctggcactccagcattctatgccttctacctcacatgaaatggattcgaattttccgaatagggcggtaatttcttctttcttcatagttaatatattcttaagttgttgtcaattgcgcaaatgtaatgttttatattcatttagcaagttattaacagataaatgatgctgagagtcacgcagtatttatattttcgcggtatatgatacgaaaagggatatattgtattttggctctactcgctctctgtagctttaaagggatggcgcaggcggtaaagacaaatattgttccggaaggttatcagaaagctcaactgtatgaaggtgatacaatggctgtcgtcaaccttcgggaagttttcatatatcctcaagttaagtttaagaataagcgtgaacaagcgaagtacaataagttggtacgagacgtaaagcgtactttgccctatgccaagatggtgtatgatacgttgatagagacctacgaatacatggaaaccttaccgaatgacaaggcccgccaagcccacttgaaacggatggagaaagagttgttcgcccaatataaaccggaactaaaaaaattatccttctcgcaaggtaagctacttatcaaactgatcgatagggaatgtaatcaatccagttacaatttattgaaagcctatctaggaagtttccgtgcgggcttttggaatttcttcgccggaatgtttggagccagtctgaaatcggaatacgacccgaaaggtaaagatgccatgaccgaacgggtcgtcgtattggttgagaatggtttaatctgatagttgcttgaagaaatcccagatcacgataccggtagtaaccgatacgttcaaggaatgctttgtaccgtattgaggtatttcaatacatatatcacagttatcaaccacattttgttgaacgccttttacctcgttacccatgacgatagcgtatttctttgtcttgtctaactgcaagttatctaacatgacactaccttccgcttgctctacggcacataccgtatacccctcttggcgcagtttatcaacagcctccggggtatccttgaaatattcccaatctacggtttcttccgctcctaaagcggtcttatggatctccgcgttcggagggcaagccgtaataccacaaagataaatagcctctacccggaaagcatcggaggtacgaaacacggaacccacgttgtttagacttctaacatggtctaaaacaacgattaaaggtatcttcttactttccttaaaagcctcgggagtcaggcggttcaattcggttacttttaattttcgcataacaaatatctttgaccgcgaaagtagcgaatatccgtggatatgccgttgaaaagctattaataagtagtggacataaaatgaaaaatatttcttgctttattcaaatacttgtccatacacccccctttctcaaattagcaaatgaataagccacttatttactacgcactatcaacagcccttatacacctattgacagccttgctggaggatctattttttcacaatcaaggttatcaacaataaacagctaaatattcataaagtctataactataagaattacaatctatagatagacatccatgctgttggtatccttttgataaaccgttcacagactttaataagtcaataaccaaagattgtaacaaaaatgtattaaccatttcaacagcctattatattcatcatatttatttttaaaattaaagattaataagaatataatataatgattgtggataactcttgaggggtgagggcaactcatccatcggtggcaaagataagaatctttcttgttatttctataaatgaagaaagtttatacctttgtgctttgtgaacaataggttgataaactagataagatgaagattatcagtaatactttctgtggataatattgtttatatatagtgaaaagcctattgggagcagtagaaacaggaatcattaatatataaggctatgttgacaaaccaatcaatcgggtacatggatgcgcccgttcctaaggatttagaccttaaggaagcgatcgacaagttacgtaaagagaagaatgcgattattttggcgcattactatcaaacaggcgatatacaagatatagcggactatgtgggagacagtctggccttggcacaatgggcggctaagacgaaggcggatatcatcgtgctttgtggggttcactttatgggagagacggcgaagatcctctgtccggataagaaagtgctggtaccggacttgaatgccggttgctccttggcggatagttgtccggctacggagttcgccgagttcgtcaagcaacatcccggtcatacggtaatctcttacgtgaatacgaccgccgccgtgaaagcggtcacggatgtggtggttacttccacgaacgcccgccagatcgtggagagcttcccggaaggtacaccgatgattttcggcccggatcgtaacttaggtaattatatcaatagcatcacgggacgtaatatgttgctttgggatggcgcttgccacgtgcatgagcaattctcattggagaagatcttatctttgaagaaacagtacccgaatgcggaagtaatcacccatccggaatgcaagcagccggttatacaggtctcagacttcgtaggatcgaccgcggctttgctgaagcataccattaagtccgacgcgaaacaattcattgtagcgacggaaagtggcgttattcacgagatgcgcaagcagagtccggataaggaattcatcccggctcctccgaacgacagtacttgcgcttgcaacgaatgtaatttcatgcgcttgaacacgatggagaagctatataattgcttgaagttcgagatgccggagatattcgtggacgaggaggtacagaagaaggccatcaaaccgatcaagaagatgttggagatctctgagaagctgggactctgatccaaacaaatacgggataggtctcaaccgataggccggacttgagtgatataaaagctaagcccggtctattatatgtaaataatcaaaattatgtacaatatctacaactatccttataattatttgattttaaaatatttatcctattgttgtagataggaaaacatctacaatagtaagtctttatctaccatcatttcccgcttttagtaagtgtctttgccatgccgtcaaaggaattttctacactctacgtatataatcagtccgtttttcttcctttctttatatagataaaatattaatatataagtatttgtggttttttatggtataaaacaaaagttttacacatggaaaacatttgttttcatagaagaaaactaaagttttgtactgaagaaacttctgttttcccatatagaaacttttgtttcgctaggaagaaaccatctgcttcgctactcgaactcggacgatcccgggaaagaatatatcaagaatgatcgctattaattaccgtaacattctgaatttagttacttttgtgtagaaatctaattgtaattctcaatatcatgaaaaagataggactaatgttggccttattatgggtgatttgtgcgctctcgtgggcttcttctccggatgcccgtattaaggggcagttaatagatgcctctacgaatcaagtgattaattatgcggatatctttctgtttacgatgggaagtgaaaaacctttgcaacagacttttccggacgatcaaggacgtttctcgtttactaaggtggctccgggtaattatgtggtcatggtccgtctgatgggatatgatgtgtttacaaagaatgatatcatcttggatgcctcgtctccggtggatttaggtaagttgatgatgagtcctttggaggtaggtatcgccgaagtggaggtagtggccgagaaacgtcaattggtttataagttggataagaaagtggtcgaggcctcttccaatatgatgggaggaggcggttccgccgtggatatattagagaatacgccttccatacgggtagacgcggaaggcgatgttacttttcgtggaagcagcggctttttggtttacatagatggtaagccgagtgtcttctcgggtacacaggctttggagcaagtcccggccgggcatatagagaatatagagattatcacgacgccctccgccaagcatgatacggaaggcgacgtgggtatcattaatattatcacgaagaagcattcccagcggggattgagcgggatggtgaatctctcgggaagtacgtggctttcccgccatgtcgatttcttgttggcacagcaacatcagcgttcccgttggtacatcggcggacagtggacagaccggttgcgcaagagtgatttcgaccaagagaagatgacggtggtgggcgatcagaccactacctcgcattccgtcgggcctcgtacgggaaacagctatcattatacgatgaaaggcggttggagcctgaatcttcccaagacaaccatcgcgttggatctggagggcggctatggcggaaataagcgtaagggagaaatgaactataaggaaacccgttcggtagcgggcggctctccggtgacggaagattatcgaagcatagatgattatgataatgatgagaatataggtttgggaagtctggcggtacagcataagttcaacgataagggacacgagctttccggtagtgcttattacaaatatggcggccatgccttggaatatttctttaacgacttgatgtccttggaagggcaacgccaacaggggcaccgtgcttatgaggccgagcaccgggaaacgatgcgtatcaatctggattacgccttgcctttcgggaaaggaggtaagctagaggcgggttaccaatattattcttatctggaagacggcgattacaatatggaatggtgggaccccaagggacaaacgttcttttggcgtgacgatatctacaacacgttttattttcaagaaggggtgaattctatctatacgattctttcccatacgtggaagaatttagaggcgcaagccggcgttcggggagagcatacgcatacggtcttgcgaagttccgtggagggagcggatcgtacgaagaatcgttttgagtttttcccatcggtgcatttgggctatacgttcccgaatgaacatcgtttgttggcttcctattcccgtcgtaccacacgtccgcagcttttctatatggagccttatatcacgtatcgtgacttttatacggccgagatcggtaatccggatatacgtccggagtacatcaactcctttgaattgaactaccggaagagtttcggggaaaacacggtatccgccaccgcctttcatcggtatcggaaggataagatcgagcggttgcgtgttccctattcagctggtgtaaccttggattcgatggcgaatgtaggacatgattactcgacgggtatcgagctaagcgtcagcctgcatccggtgcgctggtggaataccacggtcaacggaaacgtttatcactataaggtgaagaacgaacaggccgccggtggaaatacgacctcaagcaccaattacgatatcctatggaataacctgtttaatctggggaaatacacccgtatccaattggatggtagttttgtaggcccttccgtaacgacgcagggccgtacggacgcttattggtatgcgaacgtagccgtccgtcagcaactatgtaaccgaaaactaaccgccaccttagctttccgggatattttccgttctgccaaatatatcagcgatatccaaacggcagatttacgctccctgacacgtatcaaacccaaatatccacaaatcacgttgacgttgagttggacatttaatagtttcaaggctaaatccacccaagcgaaagaagatcgctcggagatgtttgagggtataaagcattgatattgtatctttactatattggtttgtcttcgggaaacaactacgattgcaaataaattctgcagtcgtagttgtttccctcttttacggatggtggaatttggttcttggcattaatcgctgcgaaaggagcggagaagataacagatcagatcatccggtcattgcgttcttctaggctttctttttaggatgatataaacagggtttctctatgtatttccaggataacatacccaatccggtgctaaggatagtggtaagagccaatgtcaatataaagctataccgatcaagtccgtaatgaatgaatatctggatgatcgggaaatgaatcaagaagataccatacgagaaatttcccatccgattgaatacatgtaaccacttgaatccataagctaccgtgataatgatagaggctagagcgataggctcgaaaatactcagcaacagatactctctacccaataaaagaaataggctgacagggaacaaatatctcatatattttcgaaaaatagggaaataggcaagtatgataataccagaacaaaagtacatcatttgtccggggaattgtcttttcatgaattcataaatagggttgtgtgtcatatcatctaaataattacacgttgtcgagtagatgaaagataagatataaataagaagtaggcatactaatttgttatatcttttcagtaaccaatagataatgggtatggtgatatatagcatgaattcaaccttgatagtccataaagacccattcatcgcttgtaaaggattggtatcgaatacgccgggtaaatccggcgataaaaagttaaatgtaagtaaattacagataagataggtgtataagctagaagaggtgaggtattccctgcaggataaggaagtaaggaataatccgattaaggcacataataaaatagtcaagctgtaggcgggcataatacgttgaatacgtttacggaaaaaaatccgggtattaggcgtacgtaagaagctaaacataacaagaaatccactaataataaagaaacctttcactcgaaatcctccgctaacaaaccaaaaaggatctgtctctgtcagtgtgctgaaatggttgaacatgacagaatacgcaagaaagaagcgaataaaatcaaaattattcgcttcttttacttgatttattaatctggagttgagtaaaactttctctgattgattcattgttctatttgactacaatgatttttgttacaacgctctctgaggcttcctctgtggaagctagtacaagatatacgcctgtcgctacacgtgatccgcttgcgctccggcaattccagatagcttgcccccccaaggatttagtttgataaataatatttccgtttaaatccgtgatttttacattcgaattatccattaatcctacaatcgttactttatccatatgttcgggacgtaccggattaggatatgcatagatctccgagtaatcagatttaccttccgaagcttctccttgataggaatttagtcctttatcggtaccgataaaaacctcaccggtcttatcgtttatctctatatcgtatatgttatcggaaaggagcgggctattggtcgtattaaattgataaacgattgtctcattatcattatctagaacatagacgccatttcctttggttccaatccattttcgattacctgcgtctacttttagggtcgtgacaacaacgttatctaagaaataagcgagattaccagtttcctcattggtatattttacccttgtacaacgtgtagcggctttatcctcagcggaagagatcctaggtttagtgaaatatacggccccccgattcgtaccaacccagatatatccatccttatcctcggctacgcatgtataattactaggagtcaattcttttccgtcggtatcaataagtgtagtaaactcatacgaggaaacttcatctaaagactcgctattcggtatcattacaagtttaggtgtgttacgaggcacataaatccatttgtcgttagtggaggttataagtatatcgtttattgtataaactcctctaagttgctcgatatccaaacgatgccatgctcctgctttgtcaagaacaagtaccgcatggttaacctctgagcttgtcatccacaaatttccatttttatcaaaggccagtccatctatataacaataaccggacccatagcctcctgcggtttctttaaaggcattcttttcattgtatgactggacgggagttccattcttatattggataacgccatcacccatggaagaggcgtatacgatctcatcattagaatcatcggtcgttacggctatacttgtatagtctcgtggatttcttggtaaattgagtttcttttgggcttctttaggatcgataaaagaccatttatcataatcgtatgtaagaatataacctcctttgtcgaagcgcttaccatttaggaggtctttacctcctatgatcatatatactttatcatttttacaaacaatatcgaatgcgctattgctgtaaggtccgtctaaaatgataggttcattaagagcctcaaaactatttgatcctttccgttggatagaacgtagccctttgcttccttccgctatccaatatttgtctgtttgataggtactgatatcattgatacttaagtttatttggtcaaacttttgcgtatcggatacgatgaaaacccttgagttatctatacatgctaatttttcgcctattactttcatgtattttagggttgagctatttattattcgggaaagctctccattgttttcatagaagataccttgctgactgaccaagtagaacaaagtattcttgaatgaagcgatagctgagatcgtatgactatcggaaaggtttgataatccatagggcttccagtttgccttatccagtaggttctcttttaatgaggcgtatataatccccgaagatacttctgccttattggttgtagaggcatatatattgccattctgtatggcacacgatgttatatttaaggaaagcttgtaggtatcttttatttcctttttggccatattgaccacgacgataccaaatgctgtcgataaataggcatattcatcatgtaccaatactgaattgatttgtttgtctcttatggacgtactggtcgacagataaggtagatttgtcgccactcctccctcaagtatatctatatttgaattatcatagataataaggagtgattttgtttgtttattatagcggatcaaagaaatcgtattatcatttaatccgtttcctttataatattgcttaatactattatcatcttttccatacgtataaagagatccttccgctaccacaaatacttggtcgttcgattcctctacgctgtttgtgttattgtaagaaagatacgttttccatccggttgtattaaaattagcggctaatacagtgaatgaaaaaaatgaaaatagaatgatagtaagtatatgtctcatattaacaattgtaatcagataaaaatgatgttaacttcatgacggctttcgcacgatggctgatctggttttttgtatcgttacccatctcggcgaaagtttgtgtataggtatcaggcatgaatataggatcgtatccaaatccgctatctccgcgtttttcggtagtgatagagccattcacgataccgtcgaaggtatattcttttccgtcaaggactagagctatgaccgtgcggaaacgtgcttttctgttttctttatgattcatttcggacaacagcttgttcatattagcttccgagtcgtgccctgttcctgcgtaacgagccgaatagactcccggagcattattcaatacctcgacttctaatcccgtgtcgtcagcgaaacaatcatatccgaatttctccttgatatagcgggcttttagcaaagcatttccctctaaggtatctgccgtctcggggatatcgtcatggcaatctatatcggataaacttatgatttccgcgtatccggcggttatcttgcggacctcgtccagtttgtgttgattatttgtcgcgaatacaagtttcatatttcgtaatctattaaataagaaagcatttctatacggtagatatataacgtatggaaatgctttaaattgtttgtatattcttttttaagtctttatctgatcgaacccctcaccatatacccctcggacaatgctttgggagatgaacgcttggtggtctatccgtttcacgatccggaagatggagacggattcggatttcttggcgagtagtacgactaccttgacgggtttgcgggaataaccgccctcgccgtccagtatcgtacagccacggcctaagtcatggatgatgcgatccgctatctcgtcgtacttctgggagaagatgaggaattgtacggattggcggttaccgttcaataccatgtcgagaacgtaattgcttatgaccatctccacgaaaccgaaaacgatcttgtccacgttatggaacaggaagaaagaggaactgatgatgaagaaatcgcaaaacagaaggatacgtccgatcgatatattcttatatttattgattaccgcaccgataatatccgtacctccggtactaccgttcgccgagaataccaatcctagtccggcaccacacataaacgctccgattatgatagccataaacggctggtcgtgcagtataggttgtcctttcagcagccactcgaagagagagagagaagccgagagtgagaaaactccgaaaatagtttttatcaagaattttagaccaaggatctttaaggctaccaccaacaaggctacgttgatgacaaaataagatacggataccgggatcaatccattggaggcaaagaagatcaatgcgcagataccacttaccccacctgtcacgatctcgttggaaaggataaaggcgttgaatccgaatccgtataataaagttccgaacaggatcattagataatcctgtacggaaaaatagatttttgtgagttttaagttcatcccactacgatattaacgattttgccgggaacgacaataactttcttaacggccttgccttccatccacttcgctgagttctcatgattcaaagccgctttctcggcgtcctccttagaaatatccgccggtagctctaggttgtagcgagctttaccattgaatgagatcgcgtaaacaacggatttctccttgagatattcttcgttgtgtttcggccaccgggcatcgcagatggtcgtatcatgtcctaattgatgccatagctcttccactatatgaggagcgaacggagccaataaagtgatcagcggctccaagatggcgcgcttgctgcattttaagctcgttaactcgttcacgcaaatcatgaaggcgctaatggacgtgttgtatgagaaatgctcgatgtcgaacgttactttcttgatcagcttatgcaaggatttcaattcgtcggccgtaggctcggcatcggtaacttgcagggtatccgtattgccgaagaacaagccccaaagcttctttaagaaacggtgtacgccatcgataccgttcgtatcccaaggcttggattgctccaacgggcctaggaacatctcgtacaaacgtagggtatcggcaccatatttctcaacgatcatatccgggttcactacgttgaacatggatttggacatcttctcgaccgcccatccgcagatatatttaccatcttccaatacgaactccgcgtcgttgtattccggacgccagttcttgaaagcctctatatccaacagatcgttagatacgatatttacgtctacatggataggggtgacctcgtattggtctttcaagttcaaggaaacgaatttattggttccgttgatgcggtacacgaagttcgagcgtccttggatcataccttggttgatcaatttcttgaacggctcttcctcgcaaacgatacccaagtcgaacaagaacttattccagaaacggctgtaaatcaagtggccggtagcgtgttccgtaccaccgatatataaatccacgtttctccaatattcatccacgtctttagctaccaaggctttatcattatgcgggtccatatagcgcaaataataagcggaagaaccggcgaagcccggcatcgtacaaagctctagcgggaagatcgtctggttatcgatcttcgatacctcggtgactttttggtttaccgtgtcccaagcccatttaacggcgtgtcctaatggaggctcgcccgtctcggtaggcaagaatttatctacttccggcagcaacaggggcagacattcttccggcaacatctgaggcatgccatcggcgtcgtaatataccgggaacggttcgccccaataacgctggcggctgaaaatagcgtcgcgcaagcggtagtttatcttcacacgtcccagatcgtgatcttttacgtatttcttggtagcggctatcgcttccttgatcgtcagtccgttcaaggaaagatcgcaataaggagtaacgccggctctcggagaattgcatacgataccttccttggcatcgaaactttcctcgcttacgtcgcaaccttccaccaaggggcggatttccagtccgaaatgcttcgcgaaagcgtagtcgcgactatcgtgcgccggaaccgccatgatcgctcccgtaccgtagccggccaatacatagtcgctgatccagatgggaaccgcctcgcccgtaaacgggttaatagcataggaaccactgaatacaccggttacctgacggtcggcgatgcgctcgcgctcggtacgtttcttggtacgatctaggtaagcgtctacttctgctttttggtctgccgtagttaattgttgaaccaattcgctttccggagctaataccatgaaggtaacaccaaacatcgtatcggcacgggtcgtaaagatcgtgaattccttgtcgctgtcttttaccttgaagcgaacctcggcaccttcgctgcgtccgatccagttcttttgggtctctttcaaggaatccgtccagtcgatcgtatccaatccgtccaacaggcgttgcgcgtaagcggatacacgtaagcaccattggcgcatgatcttttgttccaccggatagcctccacgctcggaaacaccgttcacgacctcatcattcgctaatacggtacccaaggcggcacaccagtttaccatggtctcgccacgataagcgatccggtagttgagtaatatctcttgtttttctttatcgctcttggctttccattcctcggcggtgaaactaagttcctctccgcaagctacgttcagaccttccgtaccactggtctcgaaagcctgtatcaactcgctgatcgggcgggcttgtttctcgtcgttgcagtagtagctgttgaacatccggatgaaggcccattgcgtccatttgtaatattcgggatcgcaggtacggatctcacggctccaatcgtagcagaaaccgatcttttccaattgctcccgataacgggctatattgttctttgtcgtgatctccggatgttgtccggtctggatagcgtattgctcggcgggtagtccgtaagcgtcgtaacccatcgggtgcaatacgttaaaaccttgcaaacgtttgaaacgcgaataaatatcagaagctatataaccgagcgggtggccaacgtgcaatcccgcaccggaaggataggggaacatgtccaatacatagtatttaggcttattcgtgtctttttcgactttataaaccttttcggcaatccagtagtcgtgccacttcttctcaatctctctgaaattgtactccatgatcgtttatcgtttttgtatcgttttctatttaaggccacaaagttagtgaatttatttattttatatgagttatttacatgaactgtttatttcacgtaaccaatccgggggcgagattgattctcggttcttttcgcttgtaactcagcgagtgacagattgattagctcaagttgcgtacgggtatcttcgttgatgtcgttgtaatcggcaaatgcttcttcgatatacgctttgagttcctttacttcttgttggagttcaaacaaaggggaggaagaacttattatttgtcgtatgccgacgaaagcacgcatgatagagatattgactttaatggctgtatcggatctgagtacagaagaaagcattgctataccttgctccgtgaaagcgaatggagcatattggttacctcctttctttgagatgccaatttggcataccatattgtttttcaagttgttaaattcttgaattgttaatgtgaacataaaatcatcaggaaagcgttctatgtttcgtctgaccgcacgtttcagttgggcggtttctgttccatacatttccgccagatcaaaatccagcatgactttttgccctctgatctcataaatcttgttttgtatcgcttgtaattccatagtataagaacttattagtttactttatttgatataaccaattttaggtcttttagcattgttctttttctttgtagccagttcggaaagagctatgtaaatattatccaaagacttttgggtgtcttcactgagatcattgatagcgcaaagggtttcctcattagccatttcaagagatttgatacgttcttgtagttctttaatttcgatggaactagtggtagtttgtaaggtataattccggatagcgacaaaggctctcataatgtttctgttgatttcgatcgcaatgtctgagttcagcacactacttagcattgcgactcctagttccgtgaaagcgaatggcatatatttaaagttattacctctacctttattcaaggtcacaaattgtgatcttgaaagttcctccttggtcaattcaaacataaaatcatttccctcgaatcgtttaggattacgcctgactgcctgtttaagtacccttgtctctattccatacatttccgccagatcaaaatccagcatgactttttgccctctgatctcgtgaatcttgttttgtatcgtttgtaattccatagtaaagattttagtttaatattatgttcgcaaaggtttgtaaaataattgagataagcaataagctagttggatatttatgattggttgcatttgtaagttgtacaatgaattattgctgatccggcttattgtctattttttatgtgttcttattttccttataagatttccgggaaaaacacgtacgtgatttatgaaaaacacgtacgactttttggaaaaacatgtacgtgttttccggaaaacatgatgatgtttttatatcactgatattcatgtatatataacttgatacctttgcatggacttattgtgtgttttttcttcttgtatttgttattttgttgttctatcgtttgtttatgaattaaaaatatttaattttgcttatctataataaaggatgaagtcatttatatatatactattaacttccttgactttccttgtggtaggatgccaaaatgaatctgaggaaatccgtttgatcaatcaggcggaacgcctgtttgatgcctatccggatagcgtaatcactacattggattccattccgctcccggaagagatgagtccccgtctgatagcccgttggtgtatgttgtacgcacgtgccgccgataaaatagaggacgaaatgccttatacgaaccagcttgagatcgccttgaaatactatcaaaagaaaaagatgcgggaagaggaggctgagatcggcctttatctggggcgttcgtatgtggaggataaggagtacgagaaggcaatgagggcttactccgatgcgctggaggtagcgttggcgattaagaactataatcgtgccgggtatatttgtagttatatgggggatttgtatgaactggatgatcgttatgtgttagctgcaaaaaaatataaggagagcggacggtattttcgattggccggtaatatgaaaagctatgtgcgttcgtttgtgaatgagggaaggagttatatggatgttgattctaattatttagctttaactatattgaagcgagcagaagtgataatagattccttgagagtagatgaggttagaaattatgtatacaatggtctaggtaatatatttaatgttttggaaaaatatgatttagctgaaaaatatttattgaagagcataaaagaggattcgagtgatactgcttcggattatttgaccttatcagatcttgagcaaaagcgtggaaatttagaacaagcggaaaattatcttcaaaaggctaatagtgtatccatagataatgattttgtaccggctactattgcttatcattattataaaataaataaagaaagagatgattataaaagagctttgtctttttatgaagaatatgtagcagcagaggattcccttatgaatataagtaaatctgtcgatatatatgatacagaacaaaaatatgaacatttgaaattgcataatgaaaatataagattactattaaaggggcaaaggaattatacttttatattgatattgttatttttatgtgctttactcattattgtctatttagctacgataagaagaaagaatcgttcacttttaaaacaacaagaaaaaattaatactttgaatcaaagcatatatcaattatatgcagaacttcggagaaagagtgatgaactaatccaattgcaaaatactcagtattcttcggtgaaaatgcaagtggaatatgaaaatgtacagaaagaggtagatagcttgagatctcgattattcgaattaagagaatctaaaattctcaatagtaatttagctaaaaaaataaagaaaatatctcaaactgtgcagcctaatcattctgaagcacccgtttccgaaaaaatgtggattgatattgaagttttgatgatggaagtttaccctagtgttataaaggtactgaaggatgcaggcttgtcaccatcggagatgcatctttgtttccttacattatttaaacttgattcaacagctatatctatccttttaaatattattcctacttccgtcgatcgtacacgtttgcgagtacgaaagaaattaaattgggaaggtaaacaaggattgtatgaatctcttgttaatatttagtatgtaataaaccttcatttaaggggctctacgattgtttgtctatgtatttgtttttatagtatttgattgtcaagtgtttacgtttttttctttgtctatgtggattacataatttaacccctttagatcatatataatctctagatttgcaaccgaaacataacaaaaaaagagagattatgaaaaatgtaaaatggctactaacagtgttgtttattttttcaatttgtattccatcttttgcaggtcatgtgcctttacatggtcatcttaagaaaaaacagcgatctgtaaatttggatgtacctataaaagcagacatagatgaaacttcaaaagttttgtctttggagtttttagaatatataggagaggtacgagtatctgttgtggatgcgaatggaaatatcgtttatgaggagatagtggatacacaagatgtttcttctagtattatctcattagatgaatgtacttctggatcttatggactttatatatcagattcagaaaactacgcagaaggtttttttaatttataaataattcaaattttagaagtatggacaaaaagacagtgcttttagcatctgcatgtactttattgatgatatcatgtagtaatgatgcggaattgattaatgttgctgaaacgacaggattacaaacaaaggcttttgttggtgaagcagatttccaaattgtagattatgcgggagataaatgtattcagttcaagaatgattccgtctttaatgcgatgctttgggagatgaatgatatgtcagaagaagagagaaataatattttctcgggggcaggtttcgtaagtcaatggcaacttatgcaagaagcagatcaagaacaggagcttattgtagacaattatgagaaagatcttagccaaccttggcctgctcatcaaatcaaagaattcaaacaaaaatatgatgatgttttcatgtttgaaccttatgattctacagattttattgcgcattataaattaaaaggttctacatatagttcttttgtgaatagaaggggggtgtttttgataggagatagtgtagcacatgctcctgtatataaggctttagaggaatatttcggatcagggatatcattgtatggtaataatgaagctacaaatgaaaagaatgatataaacctagctgaaagtaaatatcaaataccaggtggtgattatgtaaaggttcgagctattccaagatttatagagttacaaactattgaaaataaaaattatttgtcattgggctttgattatcttagtcaaaaaaagaaagttttatggaaaaaacaccgtacaatgattatactacgtcttacagcttcagggtcaggaagtggttttgaagtatataatgtttcaattaaaaattatcagaataaaaatggggtaacaattcttttacatacagatgtatataataaacttttagctaaggatcaaggaggtatgttagggcatgttggtgaaaatccaagaaactcagttacaatcgtaactcctcctcgatttgagttttctggacgaatggaaatttggtcagatgaaatgcctgaaagtaataaagggactgcaaaaataagtttaaaagaagactggtgataatttatgaaaaaaattttatttttactgttattggtttctacttctactttcgcccaaattgagcatggcttattagtaggtgccggtgttggatttcctttacaagatagttggaaacgaactacttggggtgatgaatcaaattggtcttatcggcacgattataagttaaatagtatgatcggttatcgctttcgattccttccggaacagaaattcttttatgatttggatattacgatgggatttcagaagatggaaacgacgaagtattttccttattatgaaagtatagaggatggtatatatgtttctaagaaagctgatgttttcgatgagtttgtgatgcctatctccgtagccgctagttggaattggcgttttaccaagaaattccatttaggtgtcggtatcgctcctacgctttatgtacagccacaagccgtgtttgacctgtccgtgatggcgaaggtgggatatcgtttaagcaagcattgtgagttcggcctttcttatcagtatggctgtttcaataccttgaagcatttcaataacggaccggctaatggccgtcgtggacatctttcggatttgatgctctctgtatatgttccttttgttttgaaatgatagaataataaagtatagaaacacataatgttttatttggaaccaaaacaaagatgaataactgcctataagaaaagagtacgtgaaaagagccatgtgtagagagataattctatgcatggcttttgcttgtataatgtatatagattctcaagaattattgaggcattttttgtttgcgatattgtctctctcgtgattaagaactatctttgacaaactatccaatagtggatgccgaatcaaaatcaattgactatgaaaacaaaaaaattgaaattcttcgtaaatttgtggttctttaagcatatcttatagtaaggatcgaatatgaaaatgagtgaaaaggaggttgatacatcaaatgaactacgggtcttgtccctgttctctggatgtgggggcatggatttaggattcgagggggattttatatgtcatcgtaagtctatatctcctcaaagtacctgggttcaagaggttatcgatgaacactgggttcgtttacagaagaatcgttttcgaacggtctttgcgaatgatatattgaaagaggcacaaaccgcttggcttcaatatatggatcgattcggatatgataaaaacgtttataatacaaagagtatcgtagacttggtgaaagagcatcgagcggggaaaaaagttttccctaaaaatatagatgtcgtcacgggaggttttccttgccaggatttcagtgtctctggtaaacgtctgggatttgagtcgaataaggatcataccgggaaattgcgtgaggacgatgaggcctcggaagagacgaggggtaaactttactattggatgaagcaggtgatcgatattacgagacccaagatatttatcgcggagaacgtgaagggactggtgaatctgggagacgtgaaaagtattattcagagagacttcgcccatgcggctggggatggatatattgttttagatcctcaagttttacatgcgggcaattatggggttccggagtctagagagcgtgtgatttttatcgggatacgtaagtccgcgttaaaggttaaggctttaagagcgcttcaagaggagaagatacccaaagcttacgatccttatccgagtccgacacatgcttgcaccgtggaagataagaaactattgccaccggtggtttgtcgggatgtatttgtaggattggaggaaccggataggacagaagatccatcccagcggtattattcacaggcgaaatatatgggagctcattgtcaaggtcaaaaggagatcgcgctggataatattggcccgacgattcgttccgagcatcatggaaatatagaataccgtcgtttatcccgggagcatgggggcgttattacggaagaattagacgccggtttacaagaacgtcgcttaactcctcgagaatgtgctttgatacagacgtttccgccggattatacgtttgtctcccataaaaagaacagtacacgttttgagttaagtgcctcaggcgcttataaggtgatcggtaacgcggttcctccagtattagcgtatcatatagcgaatcgcatacagactttatggccgttgtattttaaaaagagataatatggaagaggagaatattattactgtgcgtaatagaaatcttcaaaaagcggatgaggcttttgcggattttatgtttatgctggaatcatacttgaatgaaaaagcagctgctattccgggtacgtattgcgattgtaagagtaaggaactggaaaatgtagtagtgaacgtgatgaaagaactttgcggtagaactcctttccgtgtggaggagatacgcttggtttccgcccaatattttccagatattatcgcggagaaatattatggggttgaggtaaaatctacaaaagagaaccattggacatctacgggaagtagcatcgtggagtctacacgtgataagaatgtagaaaatatctatatgctcttcggcaaactgggaggtaagacggcggagtttaagtgccgtccttatgaggattgtctctccgatatagctgttacccattctccccgttatttgattaatatggaattaacgaaagagcagactatttttagtaagatgggagttgcttatgatcaattaaggaatgctccggattctatagagatcgttcgaaaatattatagggaaaaagccattaaagccaaaaagaaagctatgccttggtggttgggcacttccgctgaggaaagtttggaggagcatacggatatgaatataagcctgtgggtggataatggagaatatgcggatccggaaaggaataagagactaaaagcggagatatttattttattcccggaagtagtgagtgggaattatgagaatgctgccttatggttatgtacgcgccggtctgttgttaattttcatatgcgggacactttttccgcagggggccaacaattgaaactgaatgatgaacttctgccttttcctttaccgcatgtggttggtgagttgttagaatctgcgactttaataaagaactatcttcttaatagtgatgatttagacttagatatatcggaattccgtccagaacttatgttgcctaaccgatatgaggtctggcttaatgatatttggaaacgtattcatcaactaaaaccttataaaaggaaagagactatcgaagaattgggcggtatttcattggccgaatggatcgataggaaatatactttgtctgtaaaataaaatatatcttcttctcgatcgtctccctaagatcatagatcgtatcaagaagcatacctatcccggaaaaatacgctgttttatatctccacaaacggcttaacgacttgtatatggaattagtaggggattgagacggttgatttagaactaatagcgaatcagaagggttatacaaatacgtaacattaaagtttaaagctatgaagttttttattgacacggcgaatctggaccagatccgggaagcgaatgaattgggagtattggatggcgtgacgactaatccgtccttaatggcgaaagagggaatccggggggtggaaaatcaacggaaacactatttggaaatttgcgagatcgtgggcggggatgtaagcgccgaggtaatcgctaccgacttagagggcatgataaaagaaggggaggagttggcagctttacatcctaatatagtcgttaaagtaccttgtatcgaagcggggattaaagcgataaaatatttcaccagaaaaggcatccgtacgaattgtacgctggttttctctgtcggtcaggcgttattggcggctaaggccggggctacgtatgtatcgccctttgtcgggcgtttggatgatattgccagcgacgggatagagctggtacgtaagatcgtggaaatgtatgattattatgattatgatacccaagttttagcggcttctatccgtagcacccagcatatcatccaatgcgtggaggccggggcggatgtggctacttgtcctttgtccgccattaaaggcttattgaaacacccgttaacggatagtgggctagctacttttctagcggattataagaaagtaaacggatagaaaaaaaatagtacctttgtgcggattaattcgtaaacgcatttaaaagattactatcgtggcaaaagttgtggaaacccctttgatgaagcagtatttcgatataaaagcgaaacatccggacgctatccttttattccgggttggagacttttacgagatgtatggcgaggacgccgtgattggcgcggaaatactgggtatcgtacagaccaaacgtgcgaatggcgtagggcagcatgttgagatggcgggatttccacatcatgccttggattcttatctgccgaagttggtgcgggccggaaagcgtgtggctatttgcgaccagctggaagaccctaagttgacgaagaaactggtgaagcggggtattacggaattggtgactcccggtgtttccatcaatgataatatactgaatcataaagagaataatttcttggcctctatccatttcgccaaggaggtatgtggtatttctttcttggatatctctaccggcgagttcatgacagcggagggttccatcgattatatcgacaaattactcaataatttttccccgaaggaagtgttgatcgaacggggaaacaagaagcgtttcgaggaggctttcgatcctcgtttctttatctttgagctggatgactggatctttacgacctcggccgccgaggatcgcctgttgaagcatttcgagacgaagaacttgaagggttttggcgtacaacacttgaaattaggtattatcgcttccggggcgattctgtattatctggaccagacccagcatacgcatatttcccatatcaccgctttatcccgtatcgaggaggatcgatacgtccgcttggataagtttacggtacgcagcttggaactggtgggtacgatgaacgatgagggaacaagcttgttggacgtgatcgataagacgatctcgccgatgggctctcgtatgcttcgccggtggatactattcccgctaaaggatgtaaaaccgatccaagaacgccaagaggtcgtggattatttcttccgtgaaccggagacaaaggagttgctggatacgcagttggagcagatcggcgatttggaacgtattatctccaaggtggctgtcggccgtgtatctcctcgtgaggtggttcagctaaaggtcgcgcttcgtgcgatcgagccgatcaaggaggcatgtatggcgagcggggaacccagcttatgccggatcggggagcaattaaacgcttgcgccttgatccgcgaccggattgagaaagagattaataacgatcccccttcgttggtcaataagggaggaattatagcgaagggggtcaacgaggaattggatgacttgcgtgccatcgcttattccggcaaggattatttgttgaaggtacagcagcgcgagatcgaattgacgggtatcccaagcttgaagatcgctttcaacaacgtcttcggctattatatagaggtacgtaatacccataaggataaagtcccggcgaattggatccgtaaacagaccttggtgaacgccgagcgctatattaccgaggagttgaaggaatacgaggagaagatattaggggcggaagaaaagagccttgctctggagacccgccttttcaatgagctggtattggccttgacggagtatattccgcctatccaaatgaacgcgaacttgatcgggcgtatcgattgccttttatctttcgccaaggccgcggaggcgaataagtatatccgtccgatcgtgagtgattccgacaagatcgacataaagggaggtcgccacccggtaatcgagaaacaactgcccttgggagaaccttatatcgccaatgatgtctatctggatgacgagaaacaacagatcatcattatcacgggtccgaatatggccggtaagtccgccttattgcgtcagacagccttgattacgctcatggcgcaaatcggttgctttgttccggccgagagcgcccatataggtatcgtggataagatatttactcgtgtaggcgcctcggataatatctcggtgggtgagtctacttttatggtcgagatgaatgaggcttccgatatattaaataatatgacttcccggagcttggtgcttttcgacgagttagggcggggtaccagtacctacgatggcatatcaatcgcttgggcgatcgtggaatatattcatgagcacccgaatgcgaaggcgaaaacgctgttcgctacccattaccacgagctgaacgagatggagcgtgcctttaagcggatcaagaactataacgtatcggtcaaggaagtagggaataaggtgatatttttgcgtaagttgataccgggaggaagcgagcatagctttggtatccacgtggcgaaaatggccggtatgcctaaaagcatcgtgaagcgttcgaatgagatcttgaagcagttggagtccgagaatcgtcaggaaggcatcggcggtaagcctgtaaaagcgatcgcctctgccgccgaggggtatcagctgagtttcttccagttggatgatccggtgttgagccaagtacgggatgagatcaagaacttggacgtgaataatcttacccccttagaagccttgaacaaactgagtgagatcaagcggattatttccccgtaataatccgcttgatcgtattaccgatgattggtaatcgtttactttttaggtctcaccaacactaccacccggttgtcatcctcttccaatgtcgcggccacctcttttagtttgcctttcagctttccccttttatagtcctggcaaagttcggaagcattgatggtagagcacaattcgccttttgaattgatgggaggaaatgtcaccatatagatttctttcttataagaataatcatcgttgtatgtgatatagttgaaaaatttcttttcttgcgtatcgtatgcgaagtactttctcgggaaaccttctccggtgttaaaatcatatatattcgttacgctttccatgaaataataacgatcggaaatcaatcttaagacgacgaaaacgcccggatccatggtgtggatagggggtgttcgtgcgataagcgggcgcaaactgtaatcaggcattaaggtgtataccgtatctgaagaggcctcaaatagaatccaattacccttaaaaggaattatactgttatacggacctggtccagctgctcttgtttctcctttatcataaagtctttcaacgatatggaataattgcttctctttatatggaaccgtgatttctttcgttatacttccatcttgcttcgacacaagcaagaacggtacctcaaaattaaacttatcatagcaaatcaagttgtccttgtcataatcaagcatttccacgtaaaacgaacttttctcgcttctttgattcagacttcgtttgaaatttccttccaaatcatagacccttatctttttcgcatgaaaatcatttacgaaaatctcttcgttttcttcatctaacgaaaccgatctcatagacacgtattcttctccaccttgtcccttgcgatttattttgcgaatagcttttccgttccggccatatacgaaaatattgccatcatcgtaaaagtttgtcacgattatgtatttctcgccaaccgcctgcacgcatgcccgattgataaactcatcgtttgtttccagcggaatatactccacatccatgaagtcttgaaggaccaactcttttttggttgaataactatcgtttacatccacggttataagaccatcggtcgatgaatggtcgcctccacatccagccattacaaacaggatgattatccctgtaaaaatgaatcttttcatatgcgtatgatttttgtttaacttatggtggtgaagatactataaaaagccgatggttttcacgaaattatcctattatttgttgatctcactggtaatttcttgcacatcttggagcgtaaaacgccctaacaattgcatgacgctgaagctcccgtcgtccatgtcggctatcatgatcaactcctgtatcagttctccttgttgcttgacgtagaaattggctttggtctttccatcttttactcgcatgagttcttcatgatcctttccgatcaaggctttgaactcacctcgcattcgttcccttaaatccgctttttgggtggtgagtatttgcagggattctattttccctttcaggttggcaaggttgagtccggcggtttccatgaccggcatcatctgaaacatctttttggagatatatacggaagtaacatcatccatatccgcatatttgtcgaaaagcttgttctgggcaaaacagatattcacgcagcagagaagcagtattgtatatagttgtttgagtctcattgtattaatcatttaaatgtttatttacgatcttgtttatttttgtgatctcttgactggcttcattgacctgcccgagacctttgtttaaattcctagacatgaacgccaaggcattttgggctacgacagctgcctcttcaggatcggtaaaggtatcggccataacgggagccggacgatttgtctccgtgaagatgaggaatagggcgccaagaatagcggaggcgattccgcttatccaatagaaggaacgtcttcgtgagactcggggagatatctcttcttgggctaggaagtcgatttgtcgttccagcctttcggaaagtccctccggtaaggctaaatcctcttggagtgccttgtttattagttcatctatctttttatcatccatgacaacttgctttttctagtttctcccggatcaatttgcgtgcccgggaaagtaatgttcttatattagaggagctaagccctgtaatctgttcaatgtcctcataggaacaatcctcaataccacgcaggcggattacctgcctctggttctcggggagctgttctatcagttcttgtatacgccggatatcctctttttcttccaattccttttccggcgaggagtcggtcgttaatagaacggtctccaatgcctcttcgttgtctcttcggcttgctttgggcgagcgcaggaaatccagacaaagatttttgaccaatgttatggaaaatgcttccggattctggatatctcccagctcatcccttttattccataatttgcaataggcatcttgaaatatgtcttccgcatccgctttattgtctaataaggcataagcgatccgatagagtttaggatgaaagggtaggaaccgttgtttaaaaacatcaacgtccatcagtatcgcccttaataatttccagttttgtgctcattgattacccggtctagatcggacgggctgatctttcctttgatacggattaacgcattgtcgcttcctgtcgtgaatatgaccagttcacggatcatatcctcttttattttgacaagaactttcgtgcgactgtccctttcatttgccgtgaccatcgtctcataatcaggatctctcaggttccgtatggcggtagacagtcggtctttcacctcttgggcacaattatcaaattcaaggatctctataccgtttactcccattgtctcggtgaacaggctggctagcttcatcgttatgtttccgatatttacggaagtaacatcgctttcaccccggaaagcattgaataattgatccatcttctgctgcccgtatcctacttggctgataaggaggatggccagtaacactagtaatcttttcattgtaattgactttttcgttaatactatgtttttggatcgcccttcgtccgtgcgccttagagtgggggctttcacaaagaagacgggataagggatttgtttgttacaaaaataggcaaaaaagattagagtccgggcgtatttattctcgataggctttacggtaagaatgaaaagttccatagattagtactcttattttatatactgattattttttcttcagtttaggtgtccatatataggcgacggaatcgtgtaacctgatatctttaccatcgaaatataacttataggaatatttatatcctttattccagcaggtgccttccggaatgatgtatttgtaagttcttccattgatagtaaagatcgcctcaacttctttttcccggataggagagtaggtagggactatacggatattttgctcctccgctttcgcgtgtcgtaaagttacggatggatctattgtaagtaaagtggctttatatgccccgggagttcctttgatatttccggttacgatatccattgtcccggtatattgcaaggtattacctcccgcacggttaccgatctgtatggaggttagcttgaatagcccgttgatgtccgaatcttgatatatttcgaatgagagaagtgataatgcataattcatggagagtttcgcgagcggagatttacggttgacctctttttggccttgcgagagcctcccatattcataagaggggggttccgccgcgattggggatattttgatcggtatggaggtaggatctaacggtatttgtactttataaggtgagtaagcgtagatcatgactggtcgattagatctaaggaatacctgcggtgtttgtttccattttaaagaaccttttgatgagcctacagcctttgattttacgtttttataaagagatgcgcctttatataaactgtcttgattaccataggttataaataatcctatttcggacccttcgggcagaatttcggtgaatactgaagaacctgccgtataggaccgggtggtcatttcaagaactgactttcgtgcggttgatttctctttggacatccactgctgattttcatgacatccggtaaagatgattaacaagatcgtaattaataataatttgttcattttgtctaatgttttaatggaacctttcaaacaataaacatttgagccaatatagtttattattctattactattaattattattcctgttataaaatgatatttttatatattatatagtaacgattgttttatcctcttaatacgcaaagtaatctgctttattgtatactataataatcaatatatccaagagatataaagttattattaaacgggtctcgtccttgtaatagtcaaatagaagagtgtttttggcgataagttgagagggaatgataacccttgaatgtaaaagggtatttggacgagacccgttgtttctcttattgagagaatatatagagtcggctgaatgaaaaacacatcgtacgggtagtgaccccgatggtctaattcgccggaatgatagagccaattgttattttcagtgtagttgccggtggcaaacggatcaaagcttgccacggcattacaccttaataaccacaacataaaaaacttacatgatattgccaatcaatccttcgtcgttacccggtaaccagtctgtgatagagacgtctcgcaattgtaacgaccttccgttaaagcttagcttatataaatattttttccctttttcccattgggtgttagcgggtatgtcaaatttgtaggtttctccgttgatcgtgaataaggtctccacgtctccggttccgatcgtgccggaaggtggaattaccatgagccgcataggatcacaatatttctcgttgatgagggtaaccggattcgtcaaggataataccgtggatgcggacgtgctacgggcggtagaaccgatgatatcgcccgtcgtgatatcgagggttccttcgctgactaaagttgttccaccgggcttatttcctacttgaacggaacttataataaaggcacctgtcttgcctttgcttaggttcagctggaaagatataagcgatagggcatgattcatgctgagtaatacaagtggcgaggtactgttgaccgctttttgtccgatcgcatgggttccatacatataatcatcggtctccaatgcgttcggggccagtttaacaggtatctgccgggcgttaaaatttatatcttcttgatatggataatatgcgtatatcgtagcttcattagagtcaaggatcacttccggactctgttgccaccggatttttccattcactctataagcttttacgcttacgtttttataagtggatatgccattgtataaatcgtcgactgtaccggacgtgatttgtagtccgagcatagagccttctttaaattcttgtataaaattggtggattttgtagttaggatacgagtcgttatttggagtggtttttcattccagccgatattctcaagacctccgaagtctttgtcgttggagcaaccccaaaagcttaaaatcatactggtaaagagtactaaatttctcattattttacttatttttgtgtgaaacttctggatgcaaatatcgggtggttaaggggaaagggaggtgcatacggtctaaaacgtcggtgaaatcgtataaaattagatcgttcaaattgtctaaggcgttcatattgttaactgaggggtcaaaaagaacattcggggggcgtattgtttaatagataggaggtagtgttattatgttggataaaattcagtttctactaagcttacagatattaggcttttgtgtttttggtggtattaccctgctactacgggcccgtgagaatagggcaaaacagattttggggtggagtatgttattatgggcgtttttagcggcggtacgagtatcggttaacctgtatttagaggattcaaaagagatatttcatccggatgtgctgattatgggatgtattgtggtagctacattagcttgttacgtgatagaagtgttacgaccttgctatatgaccgttcgccgtttctttatttttaccagtccgatatgggtattgggtatttcttttttgatttaccggctatccggtggaaatattcatcgttataactcttttggcgaggtattcgataccttgaatctggatgtggttataaggcttttgattttatttttcacgcttctgtatatgatcgttcctatttatctgatcttgcgctatagtgagggatttaaggtgtatttaagggaaaatgtatcggacccggaagattatgatctggactggttgaaaaagaccatgctgatcctttcttctatgtatattttttatttggtattgttgtttacggatcgggttagcctatatgtaatcgacaaaacgtttttattggttttatggtactatttcttttataaggccttgttcctaaaggttatccatttggatcacacattcgagagcggatggggattacccgatttggaggaggatacggatgatgatcaaggtagtgaggaacagaaaggcatcatacgccaaaggtatgttgaggaagtacaggcgtggtttgaacgtgaaaagccctatctacgggaagatttacgcttaacggatttacagcggatcttcccgatgagccgctcttatctatcccaattgtttaataaagaattaggttgttccttctcggattacgtaaaccatttcagggtagaggaaagcaaacgtttattggaagccgaacctctggccagtatacaagagatagccgaacgttcgggcttccattctatcagtacgttccgtcgtgcgtttattaagcagacaggggttattccttccgaatacaggagagacgggaacgagtcaatttaaccggtaactgacgaaagcgaatcgcttgctatcgggtgcccaagagtttacgtttatcgtaccttgcccgccgaatagtttgactaaagtcttaggttctccgccctcggctggcataaggcgtaactctacgtttttattggcgaggtgttgtccgggttccagatcaccttttgtataggtgatgaaaacgatttgttttccatccggagagatgtggggaaaccaagaatttcgggtctcatcgaatgtcatctgggtttgttcggaaccatccgccttcatgcgccagacttgcataagcccggtacgtacggagttgaaccagatatattgtccgcaaggtgagtattcggggccatcgtccaaaccttcggctgtcgtaagacgtttttcttctccgcctagggcaggaatgacgtaaacatcaaaattaccgtttctctcggcgcaataagcgagttgttttccgtcggggctccacccgtgtaggtagctaggaccgagtggggtaatcaatcggggaacacctccttcgaaaggcagggtatagatacgcgaccggccatcttctttcgttccgttactgatcgctatttgcttcccatccgcggagatcacatggtcgttgttgcaacgggtcgcgtagtcgctattgattaattgcggctctcccggagattccggagagagcttatataattttcctccactattatatacaagccaattaccatccggagtccagttaggtgcctcgatcaaaaaagggaattccttgacaacggaacgttgcccggtcgtaatgtccatcacttccagcacactagtcacattctttttttgggcatgcgtacaaaaaacagcgatacacatacaaagtacagaattgagaaaacgtttcatatacatatagatttaaaggatataagaaaaccgggtaaaattagctttacgctattttacccggtttcaaagatataatttatttcgattactccttatacattgaaacggaaatgcatgatatctccatcttgcacaacatattccttaccttcaacgctcatctttccggcctctttaacagcagcctcggagccataagcgatataatcctcgtacttgatcacctcggcacggataaatcctttttcgaagtccgtatggataacaccggcgcattgaggagctttccagcctttatggaacgtccacgcacgacattcgtccgatccggcggtcaagaaggtttgcagattcaataatttgtaagccgatttaatcaaacggcttacgccagactcttccaatccgatctcttgtaagaacatctggcgttcctcataggtatcgaactcagcgatctcgctctcgatcttagcggcgactactagaatctgggcatcctcgtctttaaccgcctcgcgtacggcatctacatatttattgccgtttacggcgctagcctcatccacgttacaaacatacatgacaggtttatccgtcagcaagaataaatcgtgggcaatgcgttcctcgtctttcgtatcaaaagaaacggtacgtgcgctttttccttgttctaaagcctctttgtatttacaaagtacctcgtaagcgatcttggcttgcttatcacctccggtttgcgcttgtttttgcaccttggcgatacggctgtctatcgtttccaaatccttgatctgaagctcatagtcaatgatctccttatcacggaccgggtctacacgtccgtccacgtgcacgatattatcgtcgtcgaagcaacgcaatacgtgcaagatagcgtctgtctcacggatattagccaagaacttattgcctaatccctcgcctttactcgctcctttcaccaatccggcgatatccacgatctctacggtggtggggatcactcgctgcggatgttcgatttccgctagtttattcagtcgctcgtcgggtacggtgatcacgcctacattcggttcgatcgtacagaacggaaagttcgctgattgtgccttcgcgttggataggcaattgaaaagggtagactttcctacgttcggaagtcccacaatgccacattgtaatgccatattattatcgtattttttattatcaatctgttatatagtcgctccaagcgacttgttttgagttcgcaaagataatcaattttaggctgatacggttattttcttaggctttctcttcatgcttaaccggttgcctcatcgattgtttgtttaataatgttttaacgagtttgttcataggcttctttattaatgttattttttacttaggttgttctctcatatttccggtaaaagaaagtcaataacaagaatccgataaaagcgaatccggaacctatcaaggccggatatttataaccaaggccgacctccaatggtaacccaccacaataagctccgatagcatttcctaaattgaacgcaacttgtacgctggcggctcccagcatctctccacctttggagtaacggatcaataatacttgttgagggcttgagacggcgaataatcccgccgtacacagacacatcagcaagacatttaaccaagatatttgtgccaagaagaagacgagcagtagggctacgcaaatcatgccttgcgctatggccgctacccgtccgggcatatatttatcggataggcggccactgatcaagttgcccgctaccataccgaaacctgccaataccattagaacagtaaggctttcggccgagaagccggatacttgtgtcaatagcgggctgatatagctataccagcaaaatacacctccgttacctagcattgtcgcccctaggattaaccatggcgcttgagtcttaagaaaacgaaattgtcctttaaagccagtatccggaaggttctctaccataggtacccatctccagatgtaatataagatggctatgccccagcaaccaaccagtaagaaagtcagacgccacgagagcatggtgctgagggccgtccccaacgggacaccgaataggttggcgatcgtcatccccgctatcatgatagagacagcctcggagcctcttcctttatcagcaagcttttcggctacgatggagccaacaccgaagtaagctccgtgaggcaatccagagatgaagcgggctatcatcaatacccagtaattagacgctaatgcggcgcataaattaccgatcatcataatccctactaaaacaagcaaaatgtgttttaatggatatctacgggcgataatcaacatgggagcgcctacgcaaacccctagtgcataagctgagatcagatgcccggctgtagcaatgctgatgtgtaaatctttcgcgatgtcgggtaggatacccatcattacgaactcggcaatccccagcccaagggtaccgaaagctaaagcgatcaaactttttttcataacctaaaatgctcaacaatcttttcgagcgcaaatatagtgtatagtatacattattatttgcttttcggaatgtttttaggggaaagttttgcgtttcgtgatgggctgttagggtcttaaaaaaacatgtacgtctttcaagaaaaagtcgtacgtgttttcaggaaaacacgtacatgtttttttaaggggaattccggcattattttaatgcgcctccaaccagttctctccctcgccgcaatcggcgatcaaggggacttgtagtttcatgacgttttccatttcctccagcacgattttctttacctcctcggcttcctctttgtagacattgaagtttaactcatcgtgtacttggaggatcatcttgcttttcaatccctcttcctcaaagcgttcgtaaatgcgtaccatcgctagtttgatgatatcggcggcgctcccttggataggggcattgatcgcgtttcgctcggcataaccgcgtacgacggcgttgtgtgagttgatatccggaaggaaacgcttgcgcttgaaaatggtctctacgtatcctttttccttggctaccttgatgctctcctccatgtattccttgatgcgggggtaggtgctgaaataaccgtctatcagttccttggactcagaacgagggatgcccagacgctcggcgagcccgaagacggagatgccgtaaatgataccgaagttggcggttttcgccttccggcgcatatcgctggttacttcttctaccgggattccgtagatcttggcggctgtggcggcgtggatatccgctccgctttggaaagcctcgatcatatgcgggtcaccgctcaggtgggccatgatacgaagctcgatctgggagtagtcggccgagaagaagaggcaatccgtattgtccgggataaatgccttacggatctcacggcccagatcgtcccgtaccggaatgttttgcaggttcggattggtagagctgaggcgtccggtagatgttaccgcttggttgaaagaggtatgtatctttccggtctgcggattgatcaactcgggtagagcgtcgatataggtacttaataactttttaagtccgcggtattcaagaagcttgccgatgatgggatgcttgttgcgaagtttctccaatacatcctcgctggtactgtaaccgcctgttttggtcttcttcgctttctcgtccagcttcaagcggtcgaaaaggatttcgccgacctgtttcgtggagttgatgttgaattccgtgccggccagctcgtaaacctcttgctccagtttgttcatggaggcggtaagttcgcccgaagattgcttaagcgctactgtatccagcgtgacgccggtagcctccatttccactaatacatatattaatggcatctcgatcgtggtgaagagggattccagtccttctttcttcaactcgggcgcgaaataattctttagcttgagcgtgacgtctgcgtcctcggcggcgtattcggcgatttgctccacgggtacgtttcgcatcgataactggttctttccttttgggccgatcagttcctcgatgtggacggtctggtacttgaggtaggtctccgctaggtaatccattccgtgccgtaattccggattcagcaggtaatgggcgatcatcgtatcgaacagaggaccggctacctttacgttgtatttacgaagtaccaaaatatcgaatttgatgttttgcccgatctttaatgatttcggattttgcagggcaggggagaagcgttccactactttcgccgcctctactgagttggcgggaacagggacataccaagcctcgttttctttcacggcgaacgacattccgaccaatccggctttcaagggatcgatgccatcggtttccgtgtcaaaagcgaaaaattcttgacccaataaaaagcgggctaaatcggcttgtttttcctctgtatcagttaaataatagttatggggggtggactttaagtccgtgagaatcgattttttgggctcttccgtactctcgggcgtaaaaatcgcgaacaaatcgccttgaacgggacctttcggagcggctttgaccggctcagaacttagcttgttaataaatgttctaaattccaattctgtgtaaatctcagtcaggcgctcttcgtttggcttttcacgaacgcaacgggcggcatcgaactcgatagggacatccgtcttgatcgtcgccaagaatttggagaaacggatttgctcggcgttctcctccaccttcttcttttgtgcgcctttcaacttatcagtgttcgctaacaggttctcgatacttccgaattcggtcagtagtttttgagcggtcttctcgccgacacccggacagccggggatattatcggaagcgtcgcccatcagtcccagcaagtcgatcacttgctccgtactcgtgaggccgtacttgtttaagacctcgggcacgcccatgatctcgtaatcgcctccgaatttcggacgatacataaatatatgttcggacaccaattggccgtaatctttatccggcgtcatcatgtacacctcgaagccttccttctccgcctgtttggatacggtgccgatcacatcgtccgcctcgtagcggggtacttccagaatcggaatattgtaagcctctatgatttctttaatgatagggacggattgacggatcacttccggcgtctcttcccgttgtgccttgtattgctcgaaggcctcatggcggaaggtcggtcccttcgggtcaaaggccaccgctatatgagtcgggttctcacgttttaatacatcctccagactgttaataaaaccgaaaatggcggaggtattcacacccttggagttgatacgcggattcttgatgaaggcgtaataggagcgataaattaacgcatacgcatctataaggaataacttcattacttttaacacgttttagtgggacaaaatctgggtaaatgtacgaaaaaactcgcttactcgatagtttttgttacttttgcgaatctttgcatggaattatggatgaaagaaggaaaatagaagaaccggtttccgctgaatttgaacgtttcaataaggatttcgaggcatctctacgcagcgagacgacccggttacaatcggctatcgacgttatactgaattctaccgggaagcatgtgcgtccgttattggtgctccttaccgccaaggtctgtggacaggttacggataacacgatcaattccgctgttttgctggagcttttgcataccgccacgttgattcacgatgacgtgatcgatgagacgaagcaacgtcgtggcgttccctcattgaacgctatcttcgataaccgtatttccgtgttggtaggtgattatgtgctttctaccgctttgatccgttccatacaaaccggcgatttgcggattgtcgggattatctctaatttaggcagagacttgtccgaaggtgagatcaagcaattggagaccgccgaggagagtattttagacgagaattgttatctgcaagttatcaagaagaagacggctaccttgctttccgcttgcacggagattggggctatttcatcgggcgcctctgcggaggtgatcgctctttgccgtgagtttggcgagtatctggggtattgcttccagatcaaggatgatatctttgattatttcaaggaggcgaatatcggtaagccgacgggaaatgacattcgtgagggtaaggttacgcttccattattatatgccttgcggcagggtagggaagaggaggccgcccgttatttggatatgattttacggaaagatttcgcggcggagaatgtcgattccttgatcgagttcgccaaggcgaatggtggaatcgaatatgccgaggcccgcatgaaggaatatcatgataaggcggtcgatgttcttttgagattaccagaatccggggcacggacatccttgatccagctggccgattatatcatgactcgctccaaatagaaattcctttatctattagttgtagagagatggctcttgttagtaaaaaagtaagtatgcttcaatagccaatgaagttaacttgcttgacgaagtcagttaacttcgatgtcaaggtaagttaactgactttgagagtgcttaccggacacaggattctaagtcatctgcgcccggtttattagaatggactatttcccgagtcgtttttctatatcaccgaccagactgctcgctcctatacggaacaaatctttgttaagccattcatcgcctagtatctcctttacgatcgtataatatcgaactgcgtcttccgccgtgcgtacgcctccggagatcttgatgccaaccttgtttccggtgatggaatggtaggttttgatggccttgcacatggtataggcggcctcgaaagtggctcccgggtatcctttacccgtggaggtcttgatgaagtccgcaccggaatacatggctaggatggatgctttttggatgttctccgctgtgactaaagctccggtctctaggattacctttaaatgggcgtggcgacagctctctttgatctcttgtaattcttccgtcagttcctcgaaattgtcttccatgaaatagcctaggttcatgacaacgtcgatttcatcggctccttgcatgacggccatggccgtttcggcgatcttgacttccgtaaatgtctgtgaggaaggaaaacctccggcaaccgacgcgatcttaacctcttgtgcagtaagtgcctgcttaaccgtttccacgaataggggatagacgcaaatagcggctacgttcgggacatccggacgagttccctcgaaatcatttaccgtgtctaccatcttccagatactttctttggtatccagactggttaatgaggtcaagtcgatgcaaccatgaatcgttttcaatacttccggtgtaaagttttcttggaaatgtttctctaaaagagcgtttacagtctcagtggcctgggtatccggcagggccggctcaaacttattgaaagcttcatgataacggtctatctgtacggaatttgattcgtgttcatgttcatgatgatgatcatgtccacattcgcaatcgtgatgatgtgccatatgcttatagtttttgattgtttatatgtcgttctttatctcggtctgttttcttttggagattcttctcgaaagcggcggtaaggtctactccggtctggttggccagacagagcaatacccataacacatccgccatttcatcgcctaaatcccggtgtttgtcactttccttgaaagactgctcaccgtaggtacgtgccatgatccgggctagctcgcccacttcctcggtgaggatggtcatattggtaagctcattgaaataacggaccccataggtcttgatccaagagtctaccatttgctgggcttgttgtaaggttatatctgccatacttattctttattttgagagtcgataataatagtaaccggcccgtcgtttaaaagttcaattttcatatcagctccgaatgttccggtttgtacaggttttccgagttgaagccctacctcttcgcaaaaagctttatacatcggaatggcgatatccggtttagacgcttttaagtaggaggggcggttcccttttttcgtagaggcgtgtaaggtaaattggctgacaaccatgatctcgcctcccgcttcgataaccgagcggttcatgaccccgttttcatcgtcaaatatgcgtaggttggtgatcttttttgccaaccattcaatgtcttcttgcgtatccttgtcctcgataccgactaataccaatagcccctttccaattttggacttaagctgtccgtctatcgtgacggaagcgtgctgcacacgttgtgtaactgttctcatcttgttcgcttttgttctatttttgttcgctttctgttcgctttccatccagtccctcttgtagtgccttggctttcgcctcgccaatcacggatttcagttcctcgaagcttgcttccttgattcgttttacgcttttaaagtgacgtaaaagtaatacttttgtcttttcaccgatacccttaatggtgtctaattcggattttgtctgggtcttacttcgtttatccttgtggaaagtgatggcgaaacggtgtacctcgtcttgtatccgggtaagcagatggaatagcggactgtccaaacgcatgccaacggttacgggtgggaacccgaataataactccgaggtccggtgcttaccatctttcgctagtccggcgattggaatggacaagcctaattcatcttctactactgagcgaaccacttccatttgcccctttccaccgtctgttataatcaagtcgggtaggggagatcgctcctcgattgcccgcccgtaacgcctacggacaacttctttcatagaggcgtaatcatccggaccgactacggtctttatattgtatttacgatactcctgcttggacggttttcccatcttgaataccacgcaagccgctaccgcatcgcttccctgtatgtttgaattatcgaaacattcgatatgagcaggcaatttctccagatgcaaggcctcttggatctctttcaagatacgggtattccgttgttccggattcaacttttccgcttgcttcaagcggtcaaccttaaactgcttgacgttcatctcggataaatcgagcagtttctttttatcccctctttggggaatggtgaaagtgacattctctagctgcatgtccagcttgaagggtacgataatctcccgggcggtgcttttaaaacgattccgcatctcgataatgcctaggcttaacaattcctccttgctttcgtccagtcgttttttatactcgaatgtataggcttgtacgatcgccccgtttccgatatgcataaagttcacataagcggaatggtcattctctatgatcgtgaatacatctatattatgtagcatcggggttacgaccgtagatttagaacggtagttctcgatgacttcgtatttttccttgatcttttgcgcttcctcaaacttgagctcggcagcgagcgattgcatctcctcatagaggtgtttgctgatttgcgagatgttgcctcgcagaatctctttgatctcggaaatattttgctggtattcttccaatgattgcaagccttcacaaggccctttacaacgcttgatatggtattccagacaaaccttatagcgtccttgtgcgatggattcgggagtgaggggatatttacaagtgcgtaaagggtaaagttcctttagcatttgtagcatcactttcgccgtgaacaaagagggataaggaccgtaatattgtgatccgtcccgaacgatgttccgggtttggaaaacccggggaaagtactcgttctttaccacgatggaagggtaggttttgtcgtccttcaataatacgttatagcggggacgatactgtttgatgaggttgttttccagtagtaacgcgtcttcttccgtatcgacgactatatatttgatatcccggatttgcttgactaacacacgggtcttattgctgtcatgtaccttgttgaaataagaggatacccgtcgttttaggttcttcgccttgccgacgtatataatcgttccgttttcatcgaaatactggtagcatcccggcttttccggaatgaccgataggatcgtcttgatatgttcgtctttatcggctatcatacgaatagggaagtaaattggaatgtctcgctattgaacaaacctttgttgctaagttttaaggatgggatcgccagcaatcccataaaagaaagcgtcatttgtaatgaatccatcggggattttaatcgcttgatcttttcctcgatctcttcgtaacggcggctcgtctcttccaatgattcgtcgctcatcaatcccgctaccggcaaggacaggagagtgacttcgtccatgcagctcacggcgattcctcctttcgcttttatgaccacattgatcgcttgcataagctcgaaatcggttacgcctatagcgatgatgttatggctatcgtgggagatactttgagcgatggcaccgagcttgagccctgttccttttataaaggtaatagcgggaggagccgtttgatagcgatttagaataacgagttttaaaatgtctcgttctgtatctgattctacaaatccatcgaatgtatgtacaggatatagttcttctttcgtgattaattcgctgtcttcgcaaacaatgacacgcatctgttcccctttcgcttttaccgctagcttttctaatgtgatcggtttcgtgtggaaattattacgatgtataggcttttggagtggaagcgtgcatttctctccatcgtatacacaggttccttgtatataggttgcctgtatggttagatcctttaaattgtttacttggataaaatcggcggtgtctccctctcgtaagaaacctgcggggattttatagtgcatggccggattataggaagcggcccgtaatacatcatatagatcatatcctaaatccagcgatttttttaccatcctatttatgtgtcctttgtttaaaaacgaaggatgtgcgtcatccgtacagaacatgatttgttcgggatactctttcaatagcggatgaagtgcgtcaaagtttttcgccgcgcttccttcccgaataagaacatgcatcccaagctcacatttctcacggcctttttctagatagatggtttcatgatcggtggaaataccagactcgatatatgcctttagcttgggacctgtcgctaggggataatgtccgtctatgggtttacccgcttgtttcgcggcttctattttgcgcataacttccggatctttatttaagactccggggtaattcatcatctctgccaagaagtgtagatcctctcgttccaacaaacgagcggttttgtctgcgtctatgatcgcaccggaggtttccataatcgtagccggtacgcaagatgggacaccgaaccatgtgtagaaaggaatccctttcgcattgtcgagcatatattcgactccttcggtacccattacattcgctatctcatgagggtccgccacggcaccgatactgccatggcgtacggctgcgtgaatgaatgccgtaggggttaccatgctactctctatatggacatgtgcgtcaataaagccggggaggaggtaatatccctcatcttgtccggtaggggttacctttccgatatgcccgtttaggattgaaatctctgccccgaaggtgcgcctgttgattatatctaccagatttcctcgtataaccagtgttttagcttcattcatttgaatatctcctttaatatgtttcacgtggaacatttcgtgttttatcttccgagtagtaccaaaaggatgttgatgtcgctaggggaaatacccgggatgcggctcgcttgagcgatcgtgtcgggatctatccgggtcaatttctggcgggcttccgtagataaagactggatcgagttgtaatcgaatttacccttgatccggatattctctaaacggtttatcttatccgctatgatttgttctcgcttgatgtagccgctatacttaatcaatatctcagcggcctcgatgatctcttccttacgggaggccgggactttgtccagctccgcacgaagggccggaactagatctgcgaggttttccaatgtagtctgcggacggagtacgacatcgaataatttgcaaccatgggataggggggctgtgcccagtttttccaaaccgctatttatatattgaggctttacggagtaggtctccgcgaaacggatgatagcgtcacggctctcttttttctctcgcagtaaatcgtagcggtcttgtttggccaatcccatttggtaggatttctcggtgagtcgcatatctgcgtcgtcttggcgcagtaagatgcggtactccgcacgagaggtaaacatacggtaaggctcgtctacgccttttgttaccaaatcatcgataaggacaccgatataagcctcatcccttccgaggataaaaggttgtccgccgtggcaattgatgtgggcgttgatacccgctaccaaaccttgtccgccggcttcctcgtatccggtagtcccgttgatctgtccggcgaagaaaagatttcggatttgtttggtctccaaattgtgtcttagctgagtcgggtcgaagaaatcgtattcaatcgcatatccgggacgatagatttgcacgtcacggaaagcggggatcgcttggagcgcacgaagctggatatccaagggtagggaagaggagaagccatttaggtagtattcctgcgtggtctcgccttccggctctaggaatagttgatgctgcgtcttgtcggcgaacgtcacgattttcgtttcgatactaggacaataacggggaccgatacttttgatctgtccattataaagaggagagtcggggagaccttcccgtaatatatcgtggcaagcctcgttcgtaaaggtagtccagcaactcaattgttttaatttacgatgactggtatccatgtaggagaacttatggaaatcgttctcccccggttgttcctccatttcatcgaagtgaacgctccggccatcgatacggaccggtgttccggttttcatacgatctgtttggatacctaaagagatgagttgctcggtaagtccggtcgccgcaggctcggcgatacgtccgccccgtatctgggttcttccgatatgaagcaggccgtttaggaaggtcccgttcgtaagcaccaccgctccggcacggaatacgacattcattcccgtacgaacgccgcagacttgtccatgctcgataatcagttcttgaaccatgtcctgccagatggatagattcggcatattctccagcatgccccgccagcaatcgataaaacgggcacggtcgctttgggcacgcgggctccacatggccggtcctttgctacggtttaacatacggaattggatagcggtctggtcggtcacgattcccatatatccgcctagcgcgtcgatctctcgtacgatctgtcctttggcgattcccccgactgccgggttacaactcatctgggcgatcttgttcatgtccatcgtgatcaaaagcgtctttgatcctagattcgccgcggcggcggcggcttcacagccggcatgtcctgcgcctactactattacgtcgtaattgaaagtcatttttattcccttttattttacgcgaagatagtgagtgttcgtgaaagaattcgtttatatttgtataataaatacatacattgttttcaggtttaacgaactaaagatttaagctgctatgaattctattcaatgccgtatccttgttttccttgttttactgacctcttgcttcagtccggtttgtgggaaagataagaaacctcgtcaagcgatcgagaagttatcgatcgatggtccctatctattgaaagcggatgatggtagtatgcgtgcgatatctgtagatgggaaaagccggttattggataagcattataaaagtatacctaccaccttttcattcgaggtgttttccgataacggggagagattgtttccggtaaccatacactccgtctctcgtccggaatggaaagatgtgcaacctgagaagacgtttgttctttcagatccacatgcgaactggtcttgtttcgcctccctgttaaaggcgggaaaagtgatcgatgcggactataattggatttttgggactaaccaattggtgataatcggtgacgtctttgaccggggcgtggatgtactccctatctattggttgatctacaaattggagaaagaagcggaagatgccggtggaaaagtgactttcttaatcggaaatcatgagaccatggttctgggaaatgatttgcgatatacgaagaagaaatatactcaattggcggatactttaggaatgacctatccggagctttggcagaaaagcgagttgggacattggttgaaaactcgtaactctatacaagtggtcggagataacctgtttgtccatgctgggttgagcaaggagtttttagaccggaattacgatatccctaccgtgaatgagatcgtgagcgatggtctcttcttaacgaaaaaagaacgtaatgcagataaaggctccgatctttcttttatgttcgctacgtatggaccgatctggtatcggggtatggtacgtagcgcagataagtatcatccgctagaccgggatgatttgcggaaaatattagagaaatataatgtgaaccgcatctttgtaggtcataccattttcgatgatatcacgactttctatcattataaagtgattgccgtgaatgttgataatcaagaaaacaaggagaaggaacgaggccgtggtgtcatgatcgagaaagacggttctatgtttgtcgtatatgattccggaaaacaagagccgttattaaccgagtaatatttggtgcttgagctgtcacgactgctaccatcatggtagaggaagaagtgcctcccctaatgtgaactaatgagatagggagtgcaacttttatgtatcttaaatcatctataaatatagatatgttttaaatgtaggagttatgaaaaaagttgtattactgtttatcttgtttgttttctctttgtcgcaagctgatgctcaagagttccattttattcctaggattggcttgaatttggcaaatacttatcccgaaagttttgcggacatgcgtccggggttaaatattggtgtggcggaggaaatacgttttagcaaactgtttgctttagaaccgggtgtttattattctatgcaaggttatcaaaaagaaaacgctaaaggcgagacagcccggctaaaggcggattatttaaatattcctatttacgctaaattttatttgtatcggggattccatcttttcgcgggcccacaagttggctttaatataagggcgaaagcttcgaattatattttcgtctcgggtcctactccggtgcaccagagcgagtacgatttttccggtgataaaaaagaagagatccgaaattgtgatttctccgtttcaatggggcttggctatacctttgacatgggattagttatctccgccaattataatttaggatgtactcatttctttaaggagccggaatactcattcggtggaagcaatcattttaggggaaaagatcataatggggttattcaattcaatctaggatggcgtttctgatctccagtaaatcgtgaattaagagagatcgcttgttcctcgttcagccttgcggcatggctacacaggcaatggactgctttcgggcattgctcgtccgtggcgtagcaatacgtgtaatcgtaaggtatgtcttctgttttcatgttgtctgtattatttttatttatttcaacaatagtctgctctcaaccgcctctaatatcttcatttgctggatcgctatttgattaagctttattagtcgttcacgctgggtaagtccttcatcaataaatacagcattcaggctttccatattcgataaacagataagttcattaatagtcgcatagtcacgaatgttaccttttaattcgggattggcttcccgccattgtttagcggttgtgccgaatagagcgacattaagaatatcggcttcgtttgcgtatataaagcttacctgttgcggggttaactctatggggatgagattatgcttgatagcgtcggtatggatgtgatagtttattttggagagttctcgtttggcagtccagccgatttgtttctgttcctcttcttttaggcgttgaaactctttaacgatatataattcaaattcaacagagatccaacttgcgaatttgaaagctatatccttatgagcaaaggtgcctccatatcttccggatttggagataataccaattgccgctgttgtatttatccatttttgtggagaaagggtaaaagcatttaaccctgcttcctttttaaacccctcgaattcgaggggtttaaaattaggattatataaactttcccatatacctaaatattcaatggtattacgattacgcatccaattgccaattactgctgtcggatcatcgcttttgtactttgcgatgtcggtaagtgagatatagtcattcttatttatagatatgatcatgacacttgtattttggactgtgattttctccataattttcttcagataagatttgtagtataaatttgtttctggttaacatctctttaccgacattcctccggcaagatcgctaacgctctgttctcgttctcctccatgatctcccgctcgccggggcctttgtcgttgataccgcaaaggtgcaggatgccgtggatgatggtacggtggagttcctcgttataatccgtgtggaatgtctcggcgtttgtcctgaccgtatcgaggctgatgaacaggtcacccgagatcttatttccttccgtataatcaaaggtgatgatatccgtgtaataatcgtgttggagatattggcggtttacctccaagatcttctcgtccgagcagaagatgtaactgatatcgcctgtcttcttcccgtaggtctcggccaccgccttgatccatccgctgaccgcttttttcttgattgccgggagctggatatcctcggcgtaatatgctattgccataaggtctatttatcgtattgaaatttcgttacaaatgtaatcattcgattttaaatagattcatttcaaatctattgattgtatagaatgttaaaagaacaggtaagccatcgctatcgccgctatcgccccggccagatccgctaacaaggcgcattgcaccgtatagcgggtattacggatacctacgctaccgtagtaaagagcaactacatagaatgtcgtatcgcaagagccctgaacgatggatgacaggcgaccgacgaaagagtccgctccatacgtgttcatggcgtccagcatcatgcccctagccccgctcccgcttaacggtttcatcaacatggtaggtagcgcttccacgaaatccgtgttgagccctatcgaagcaatgccgaaacgaacgccttgtatgatgaaatccatcgctccggaagcccggaagacaccgatacctactaggatagctaccagataaggaataatcgttatagcagtctggaaaccttctttcgccccttctataaaagcatcatatacattgatctttttacgcatgccgctgatgataaatccgcagataatggtaaaaagaagcgtgttggcgaataaagtcgaatacaaggaaacttgctcctgttccatcgagttaaatagccataccaggcctccgataaataatcccagtcccccgaaaaacaggattaggttccgttggaggatattgatcttctgccgtacgcaaaccgctaaaatagcgactaaggttgatgtgaatgtagcgagcatgatcggcaggaatacgtctgatggattcgccgctcctaactgcgcccggtacatcatgatggtgatcgggatcaaggtcagtcccgaggcattgatgcataagaacatcaccatggagttgctggcggattctttattcgggtttaattcctgtaactgttgcatggctttcaatcccattggcgtggcggcattatccagtcccagtaaatttgccgataggttcatgaagatagaaccggtcacgggatggtctcttgggatatccggaaaaagcttgctgaatacgggagccgccaatcgtgcgaacgcttgtatcaccccccccttctcgccgatcttcatgatgcccagccaaagcgacaaaatccccgttaatcctaacgaaatctcgaaacccgtcttggccgaggcgaaagaagcgttgataatctcggtaaaaacagcggtatccccacctatgaccaatttaccgatagccactacaaaagcgattaagaaaaaagcgatccaaatatagtttagtaccataataaatatatattggtcacaaatttaggaattaattgccaattgatttgtatttttgctttttgaataacaaatagatccaagatgaagatattagtgacatacgacatgttccgcaagggatttaccgagttggaaagtaagtacgaggtaacctttcccgaaggaagagattttacgtatgaggaggttttcgagatgataccggagtacgatgtgctctgctccatgttcgatttcccggtaaacaaagagttgatcgaccatgcgtcgaaattgcggctgatcgctaactacgccgttggttataataatatcgatgtggcctacgccctcgagaaaggtttgacggtggcgaatacgcctgatcctgtcacggcccctaccgccaatatcgctttaggcttgatgctggataccgcccggcgtatcacggaatgtgatcgtaagctgcgtacgcttggtaaggacatgaaggtcggtgtactggagaacctcggtatgccggttaccggacagaccttgggcattatcggtatgggacgtatcggcaaggccttggcgaaacgggcgaatgctttgggcatggatgtgatctaccacaatcgccgtcagctttgcatcgaggacgagaccaaattgaatgttacctacgtctccaaggaagagcttctggcgaaagccgatttcgtatccttgaacgccccttatacccccgatacctatcatatcctcggcgaggaagagttcaagcagatgaagccttccgccatcctgatcaacacggcccgtggcccgttggtggatgagcatgccttggtaaaagccttgcgagaaggtacgattcatggtgccggtttggatgtattcgagtttggagactatcctctccccgagttattggaaatggacaacgtggtattaacccctcatatcggcacccagacgatggaaacccgtatcattatggcacgcacggtatgcaacaacgtgatcgggttcttggagggcaatcgtcccgtatcacgggtactccggccatgacggcggcgtttatcctatccgagctacagtcggtcggtacacccgagaaggcggttcatttgagccgctttttcaagactggtcccggtcaatatggcgagggcgatcagtttctcggagtggttgtcccgcaaacccgcagcatagcgaaggctaataaggcgactcctttcgatgagctgcagctgttgctggatagtccgtggcatgaggcacgtctatgtgccttgctgattttggtctatcgtttccaggatcggaaagcgatgccggaagagcgggaagccatcttccgattctatctgaagaatatgcggcgttgcaataactgggatttggtagatttgacctgtcgggatatcgtcggcgaatatttggtggacaaagatcgttccctcctctaccgtttggcggaaagcgagaatttatgggaacaacggatctcgatcgtctctacgtgggcatttatccgtcggaatgattttggggataccttggagttatccgaacggttgatcggtcataaacacgatttgatgcataaggcggttgggtggatgctgcgtgaggtcggcaaaaaggagcggcagacgcttaccgatttcttggaacgcaacgctactcgtcttcctcgtacggcgcttcgttacgctatcgagcattatccggaacccgagcggcaatattttctaaagaagaaataacatggatacaaagaccatctctttacttcgtgaatgggcgaaaacgtacaatacggaatcgtttatcaaggatgatccggttcgattcccccatcggtttacggagaaacgggatattgagatatcggctttcctgacggcgtggatctcttacggtcgcagggcgcatattctccaaaaagcggaagagctacaccggctgatgggcgaaagtccttacgagtttatccgtaccggagagacttctttcgctcccctacggaaccgcccggttcgcaggcgggataccttttaccgtttttatacctatcatgatctgcatctcctttgttgtcgcctaaaggatatatacgatacctacgactgtatggaagacgctatggccgccgccggtccttgcgaagatcctatcttgcggttgcaacaactttttgctgatctcaatggcattccggtcttgcacgggacttccgcttgtaagcgtctggcgatgttcttgcgttggatggtgcgtacggatggtatcgtcgatctcggtatctggagaacagccgtgcatccccgccaattaatcatcccgttggatacgcatgtgcaccagatctccttgcgcttgggcttgacaggccaaaaaaccgctacccttcgtacggcccgtgagataacggacgcattggcgaaagtcttccccgatgatccttgtctgggggatttcgccttatttggctacgatataaatcaagaataaaaagatatggaagaaaagaagataaataacatctcgtctgtttgtgtgtattgcgcgtccagcacgaagattcccccgatttattttgacgccgccaaggaattggggtgtcttttgggagagcgaaaactacgggtagtcaatggtgccgggaatatcggtttgatgtgcactgtctccgacgctgcgttagcggctggtggaacggtaacgggcgttatcccccattttatggtggagcaggattggtatcataaaggcttgaccgagttgattgaggtcgagacgatgcacgaacgtaaacagctcatggcaaacctctcggatgcggtgatcgcccttcccggtggatgcggtacattagaggaacttctggagatcatcacttggaaacaactcggtctctacctcaatccgatcgtaatcctcaatattaatcattactatgatcccttgttggaacttttgaggaacgccatgaacgagaatttcatgcgtccccagcacgccaagatgtgggcggtagccgacacgccggaagaagctatccgtctcatctacgccgagccgaaatgggacgcaagccttcggaagatcgcggcgatttaaatcttaaaaatgaatatgataatgaaaaaactaggtttattaatgatgttgttgctcctgtcaaggatcgctttgttctgccaggcacagacggcgggtatcgaggagaaggaagtgcttaggaatgaagatgtgattttccatcagattgatgagcatacatggtttggaacaggtcatttaatggcgaacgagagcctgtatctggtcgagggagaaacgaaagcgatcttgattgatgcaggaacaaagatcaaggatttggataagctagtggcttccatcacggacaagccggttacgctggtcgccacgcatgtgcatccggaccatacaggctcggctatcgattatttcccggagatttatatcaatccggctgatacgataggtataccggaatttatgccgaattataaaggcaaggtctgtttcctcacagatggcgaaattctagatttgggtgggcgtaccctcgaagttgtctttactcccgggcatactcccggatcgaccacttttgtggataaggatgccgcttatggttttagcggcgattcgttcggctccggtaatctattgctgggagttgacttctctacgctaatatctacttgtaagaagatgagtgcggtgatcgagaaatatgatatcaaatacctctaccccggacattatttcggaatgaacaaggaaacccctcaacgtgtaaaagacatgatcacgatgagcgaggatatcctgtccggcaaagcacaaggcgagcctaacccacaaggtatgttggggctagaccgagtatacacgaagtatggggttcgtataaattataagaaggagagtatgaaataaatatgagaacaagtagatttagcatatattaatcttaatatatacagaggttcaagctcctatgatagaaatacccccaaagttgtctatttaactctaggggtattttattttggaatattaattattcaaaatccgaacagtcatattcattttgattatgataatctatgaaacatgtatatttcatatttataggaggtcgtacttgataaaatttacctgctcttaggtaaaaatggtcattagtccaatttcctcgatctaaatatgtagtgcctattgtttctgtcatgcgatgaccatatgcaattggatactctatgccttttgtttgattatgaaaagtgaggttttgatctagttttacctctcttgctttactaacactataattaggtccaacatattgttgtaatataaggcgatttatattaaatccaatatagttttgggctatcgttttgattgaacaggctttatctgcataaaaccttaaataaacattagcatcagtataccatgatttaacatttccacctgatacatctttggttatatcatattcaagtcttgcataaacaggatcactgtctatatctattttgaaattaatgcgatatggagaatcgtcactatagtttgcaaaagaacaaaaaattggtttacctggtgaggatgctgaaaactctcctccctctgtaatataatttgtgaattctttaatacctcctatagttttaactcctgtgacccctgatcctcctgctatgaaaactttcatttctgcgctattgaaaaaggcttcttgctcctttgtgagtgtattattcttgttaataaatagcgaattaaaagtttctttcactaatttgttagctttttcataatcgtaatttgtttctagtgtgagaatacctattcttccataggcaatagagctaacgtatacaggtgagtatcctcctggcatagttcctgaaattagaccattactaggaatatccatgtctaatgtgaaatatttctgaataaattttatgcaaagtccagagctgcgtatgattctatatttattttgatattgcgcagaagaagttccccaaaacaataatcctgtattttcattagagccaaaagtcatttttaattcatcatatgatacaaatttttgaacatcaaaacttaatgttgcactttgttttcctatattattttgttgcattagatccatgacaaattgtctgatattcaataaagaaggctcttttatagttcctcctacttttttagcaggaaaagagacagagacatggaccggattgttttttacaggtattggagtaaatcgtgtctctgcaatgctagatgcttccaatattgatcccgggtatatgtatctattcatattgtctggtattaccatttcatccgatcgggctgtaattgttcttccaaatccatttgcccatgcaatatcggagataatatttacactttttgtaatcgctttttcttctaaaatatttttagcaagaaaaggtatatgattatgagctgttattgtgacagtgggttcaggatatttctctaagattcctttagtcttattatgaataaggctatcatcatttgaacatgataatcctccaaatatgatgattgtaaataaaaatattgatgtaattctcatagtataattatttataaggtatgtttactctgaattttgcgtagaatggagaatcatcacttaagtagcttgctgaataaaatataggatctccaggaacatccttactaaattctcctccagctataataaattccttaaatccattaattccatccactgttttcacagaatagctaccatcaccacttatgattgcaatttttaagtctgcttcactaattattttcgtttgttcacttgttagctctaatttcccatttattatttttgcatcaaaggctgcttttactgctactcttaatgaatcatatgcataactagaatcgaacatcattactcccattcttccataggttattgaacttatataaacaggatcgtatggaccaacatttgataattcattattgttttttaaaaggcatccatctgctggtaaatctaaatcaactgtgaaatttttttgtataaatttagctactaatccacatttcttcctgatctttccttgcgcaacacttgtagatatgttaaaaacacttgcaacgtctatattgcaattaaatgctaattttaattcattataataggtgaactgattcatgtcatagataaatgaaacaatctgtttgcctgtcatcccttcttgattcattattttacttaaagatgttctttgcgactgcaagctgggcttctctattatatctcctacaatcttagcaggaaaagagtaggatatataaagagggtctaattcgtttgttaagcgttgaaaacgctgttcttctagcgagccacctttcagtaatgatcccaaatagatgtatctcattgtattggctgttgtaccgtgttcatttgtttcatatatgagtgaatgaccttttttatccggccaaacactatccttaatgagaaaggtagatcgtgtggttgcatttaaaagagctaagtgttctttactgccagtttcaatgtctatgactttctgaggatatttggatagtgttaagacttgatcctttttactattgtctggatttttgtatatatcttcattgtcaacgcatgaagaaactacaagtgaagcagttagtaagataaagatttcttttttcatgataatatatatttataaggtgaataattgctgtgttaattttgttgcattttaatataggatctttatatatcaaatgttccaattgaaatatttatgatcggaaggataagatactgctctcctttagtttgtggttgctcaaatatttgctcatagattggagatggttttaggtcaaaatttaaatttgcatttttagtgtaaaaagcacaaaaccattcaggaattccattcatgttgtatgctccatatctctcgataattattttgtaaaaaccgatttctttcccttcttttactatattagtaatacctccataattagttccaatcttatattttaatccttttaaaggatggtgctctttttctgataatttgttgttaatatatttttcttttatacattgcagaggtatttcgaatctgcctccggctgaatgtagtatgaagggattttctttagttataatcaaatatttaaaatctactttgttttttgagattaactcaattaatttgtatttagtctgattattgtcaaaattagtattaacgagggtctttttttcaactagtaattcatactcataccctttttcataatggaaaccctcgatcgcagaaatatttatttcttgaaaatcgacttgattttcttcttttgctagtatatattcatgattttcaatatcttcattttggattctatttgtttctgataaaagaaatattttgacagtttctgttttgattagaggggtgtcttctttattacagctgcttgtataaagtgctaataataatatatttaataaatgtctagttttcatatattgaattttatgtatatttgtgtaaatatttactttgctaaagtagatatttattgattttatagtgatgaatatatattaactacttgagatgccgtatgaataaatgataatttttatcatgattgttttctttgtaaaagtgaaggtttctaaattattgatttttgctgtaaataacaaagctactaatctttatataatttataaatgtgattatatttgtgctagtttgtatttcttcctaatgttttcaaggatactaaatgtcttatccaactcctccttcgtatgcatagctgttaagctgaagcgaagacgggataatttttccggtacagctggataactgattgggtttacatatattccttgctcaaatagtatgcgagctgcttctttcacattgtgttcattacgtaccattacggggaatatagctgattcggtattaccataatcaagacctagggtttcaagtccggttttaaaatattcgatattttcggctaatgtatttctccattggggttcttggtcaatcagttggatggcttttattgcggatgcggcggtttgaggtgtagcggcggcggaaaatatattttgtcttgaataatatctgagtaaagttatgatctcttttcttgctatggcataacctcccacgcatccgaaagctttactgaatgttccggttatcatgtctactttgtcgagaagaccataatcttcaataattcctcggcctgttttgcctaatacaccaataccatgagcgtcatcaacaatgagaaatgcgtcatgctctttacatacggcataaatttgatcaagaaaggcgatatccccatcttgggagtaaacgccatcaataattacaaagcgatttttgaagttctttgagttgtttaagacatgtactaaagaatcaatgttgttgtgaaggaatctctttgtattggtacataaacaaccgtcaaatacactcgcatgagtaaacatatccatgattgcgatatcttctttatccatcatggccagtaatgtgctgcaatttgcggcgtatccggatgtataggttatcgcatactcatttttcaagaaatgagcgatctcttgttctaactgctcatgcaagaaattgtgtcctccgatcaaaggactggccccagctccagctccatattgttcaagtgcgtcaatacctgcttttattacttccgggtgatgcgatagacctagatagtcattagatacgaaactgatcatttctttttctttatttgaatatggatcgaccactttcatatgggcactagaaccggtcaaagagatgacacgataaggtaagtgctggattttatgtctatatgatatataatcatcaacctgttttgctctggttaataagtcttgacctctattttcgaagtcttttaatgtcatgttgtcaaattcgttttgcatataaacccctctcttttaatttgacaaaattattgacagttattatattatgaaatgaaactattttaattatttacttaggtttcttactttataaagaagattaaacataacagattctccattatcattctctaacgcaaaagtggaacgaaaaataagttgccttattaatgaacttttctccttatttgacttaatctttggggggtgactcctatgtaagatgccaaatattttaatggtatattattaattagttctttttctttggttataagatcctcataaatagcttcggcggaggaaccaagtagcaaggtctctcttgttattttccggcataaagcatcttcgagaacaattcttgcaatcttatttatgtttagggaggtttgatataaatcagctaagtctagcttcgataatttccagattacacagtctgtcaatgcttgtatatgtatgagtgatggctgattttctttaagggaaaagtacgagttggcgaattcgcccgggaaagaaaaccaaaaggtgatttctttgtccggatcaccatattcttgtgcagtccaatagcgtaggataccactttctatgaaataaagatatttttcgtaatcaccgattcttatggtaaactcgtttttcttgatttcttcacgttcgaagtgttcacaaaaaagttgttgttcttcgggtgttaatcgtagtcctttatttaaggagtctataacgttaacggattgctctattaataatgcgatgttggttttcatgtgtttagtatgtttagctggttatgttaatatattctaagaacaaagataatgctaaaagctggataatcaagatttattcaaggtaactgcaccaaaatatctatgaaatagagattaggaagaaatactgttcagatctgatgataaggtaggcttattgtatatttccatatacgctcttgttttctgtcgtgtgattcagtaaaaacatgtacgtgttttccgaaaaaacatgtacgactttttccaaaaacacgtacgtgtttcgcggaaagtataatcgtctttttaagatgtttatgttcaatgatttatataagaacattatttacgtgcttattgtctaggatttgccttgggatacgtatgctctaaatagactccggatactgaaaatcgggtgggaaaagtaaacagggatcgttggcaaacttaccagcgatcccactaaatccctattataatttcgcttgattcacttgcggcgtgcggatacccggtttcaattctccgttgatgatagttaaccggccatcttggataaccgctcccgctccggcacgggccaactgctcatattcgcccagatcgctccatgctttcgtggataggtcgtattgaagtaaggtggtattgaatcggtaccattctaccggatggtgcatataggccttggcttcggcttgcaggcgggtaatggccgctgaatctcgcgccgcctccgctttcgctaaatggatcggtcgggcgatggcggctaagaaacaatcgtagttcacacctcccataaataagattttatccgtttggaaagtcacggcacagcctcctgttagggtacggttcgttccgtccttaaacgggggaagaacggtctcttgttgccaggtaaaagttgccgggtcgaataccaatacatccgtcgggacgatcggttcctcttcgtttaggatgggctggaagcctccggctagataaatacgtgtgccgttgggactttctccggccgctaataccggttgtacacgggctgctcccgggaagtccggtagttgttcccatcccttttcgatattcgcgaggttgaggcgtaagaaggtatggcagggctgtccgttctcatttccccctgctacgtaaatctcctgtccggtaaaagcggccgagagattatccattggagacggtaaggggggtaaggcgcaaaccgctacctctcctttcgtggggttataggagatgcgggagacctcgaccaaggaagaatcactgttgtttcctccgatgcaaacgataccttccggggtggaaaccgtagcgccgtaggcgacgggacgaggcagtcggtcgatctctttccagccttcgggaagaaggacgaatatctcgctataatatcgcttggctcctccctcggtgacgggtttgtccggaaagttgcaacctccggcaacgatcaatacgccgttatggatgccggcgaacggggcggaaacgccaagggaagccgtatcggctgctcccggtagatccggtaattttgtccagtttatcatggtgttctgttttttagatacaggctggccgcatcccgctacgcagagtagcaggaggaacaaccagccggtgatttgttgtttattatgcatagcttattcttttattgcccggaacgtagaggccggcatgcccgcctcgtttataagattcgctctcgtgaagggttgccagccgtagcgtaccagcttcgggtgagtcacttgatcgttccacacctttactttcccgttctctaccacggcttgcgccggatagtaaagtccttcctgctcggcgatctcgaatgtacggatggggtccccatcggaggttgtcaagccctttgcgtaatcgaaagtgatataggcggcgttatcggtaaacgttgcgctgcggaacaaagggccggatgggattacgttatgtccgtaggtcttgttcaaggcccaatgtgccagtcgttcgccaatctctttttttcgggtagggtgaacgtttaaagaatccccgcgatcgctactaacggccatacccgtattcgatacggtttgcgccaggcggcgttggctgtccctgaaccaagtccaactcgggcggtctatgctggatagttggacatagtagaaaggcaggtctgcgttccaattctggcgccagctgttcaccaatagcgggaataatcgttcgtgtacttccatattatgggcgttcgattctccttggtaccaaataatccctttgatgggatattgatgaaggggttggatacccgcctcgaacagataacaaggctcatacggatggcgttggagcgggttggatgcttgcttgatgtttaaggccgcccgttcacgtacccaatcttggataaagtcgttcttcgtccaatcctgtaagatatccggaaactcgaattccagtgttttccggtcgatccatgcctctgtaggcgagccgccaacagcgttcaatatcaatcctacgggtacttgtaagctatcggccagcatacgcccgaaggcaaatcctatggccgagaagcgtgcggtattccgcgtgtcgcatacttcccattgggtgtcgtggtaatattgcaggcggttcaatgaatccagtacggaagcgtcccattccacggcgtaggtctcccagcggggctttaggtcgaataaacggatttgcgagtgttgtttcacgtaatccaattgttgctgttgttcttcctttacgctctcgtttacccggaacgccatgttggattgtccggagcatagccagacttccccggctactacatcccgatagttcagcgtgcggctgggggtagaaaccgttaaggtataggatttcccgcttacccgtaaggggtcgagcgtgacagtccatttcccgttcgtaccggctacggtctccttcctttgtccggcgagggtaacggttactttctccccttggttggcgataccagatataggaagcggttgatcccgttgcaagaccatccggtccgaatagatggcaggaagctgtaatcctccgtaatcgccggttagcgccccataaacggtgcgggccaagataccggcaccttcagcgttgggatgcaatgcgtcgggcaatagatccggacggtcatataatccttcctgcaaatcgatcaaggttgcgccggctatccgggcgatttcttcgataagcgcttgctccatccagtaccagtctcttgtaccggatttaaaacgagaatggcggtgagatatcggagtcatacggcaaacccataccttgcatctcggattggctttccggaaggattcgatcaaggaaagataatcccgaacgaaatcgtcccggtaattcggccatgcccgagggtccgtatcgttcaatcccagatggatgatcacgtaatccccggcaaacctcagtgccttttgatacgcttcttgttgggtataaggacgatatcccttgtttaataaagtagccccgctatgcccgaagttctccacttcgtaggcatctccaagcatctgttgcaattgggccgggtagcagtttgtttccctgttcttgattccgtagccgtaggtcacgctattacctacgcaagccaccttgatcttttgcgcttggctcataaatgcgaaagcgaggaagatggataagattcctattatttttctcatttcattcaaccgaattagacgttatttaagttgtttatccggagagtaaaccagtccttccaccgctttctctccatccggggtgacgcaaacgaacgtaaacatccatttcaccagacggacctcgggggtattgaacgtaccgaccggaagcttcatgaacaccttgttccagcctttttccagatggaccggggttggtttacggcttacgcagttctcgttccccagtgggatctcattggacttctcccggtgggtagcggtccatacggggggcgttatctcttgatcatttacccagatacggctttctttataatcccattttccttgcattggaggtagatccatttcagaacggctataattttgaaattcgatccacgtacctacctcttgcgccttgggcgaatagatccaagtccatgcgtaagcggtatggttcggttgcgggtctttataggcaccgggaaccagcggtccccagacatggcgcaggtagataccggcaccgatggcgtcgtgcgtaccgtaatttttcccttcataggtatattgcgcttgaagcgacttttccggagggaaagaacgggtcagttccccatcattcgggaaagggtcggtgatacgccatctcacgttggtttgcttgacgtaggcgaacgggtatccttggaaatgatgttctttatgccataacatccgccgctcaaaatcgacaaatgccttatgttcctcgttatcgggatcgataggcagcatcgttccgttcttatcgaaatattgatagccgccgcccaaccaagaacgttcggcgatcgctaatagattcggatacaaattattctcccggatcaatttgtcctccggctgtacgacccggtcgtgccatacggcaaggatcgtacccgccaaatcatggcttccttgcggttcattgtaaatacggcttttgtataagccgatcaagtcggcgaacgtatcaaaatggttgatataatggaaacgggagtcgatcgcaggaatgcccggtcgcgcttttccccggtaactccacatttgctccatgtcgatctcacccggtttgtacttccatcccgggttccaagagatcacttgtttccctttcgcacggatataagcgaccatctcgggtacgaacttcggattggtaaactttacctcgtccgtaccgatatgtaagtaaggaacctcctcgaatacctcgcaaacctcatccatcaatagttttaagatcgccataccctccttgctctgcatatcatgacggaaggcccgtatgaaagcggcgctatgtcccggcatatctacctccgggatgagtagtacgttatgttctttacaaaagcgaaccagctcctttgcctcctcgatcgtgtaatattttccgggcatacggctcatattgcagctgtcgttcagcatcggaaagatcttgctctccagacgccaagcttggttctccgtgagatgccaatgaaatacgttcatcttgtagcgggaaagtacctcgatctcccgtttcagttcttccatggagatatagctccgccctacgtcttgcatgaatcctcgtatgcggaaagcaggccagtcggtgatctcgcaaccttggatggaatatcgcttcccttgccgctcggtcagttggcgcaaggtttgtatcgcccaataagctccttgctcggataccgcccggatggttatcccccgggaagagacgcttagttgataagcctcctcggagttgagggggattccgtccaatttgtcaaccaaggaaacctctatcttgtatcggctgtccggttggacgcttaccggcagctcctccaagaattccattaggatggaacggagtttcccttcggaagaaactgcgatttccttcggatggaacgaagcgtttgtccggacgtatttttggggcaagggcaataaaacaggattccgggccatcagaggcccggaatacaagaaacttaaaacaattgcaaaatgcagtatatatcgcatatacttagattattgatgaatgatatcctgtaatttgatagcttggaaggtcatatgtgctacgcttgactcgtagaagattcctaccgtttccttatcgatcatcgaaagacaggaatatccccacccctcggcctcgtctaataagacttgatgctccgtgggccatgtaagtccaccgtccagactcgccttgatcgtgatatgattacgccctttcgtcgtgttcggattggagaagagtagaaggtccttgccggtgatgttatccttggcgtttaccttgatcaagctggccatacaaacggattcctgtaaggcgctacggctggaaggatgctctgtccatgtcttgcctaaatcctttgtggtggccacggcacggctaccgccccggttatcacgcatatttaacatcaatacgcccggctctacctcggcaacttgcgcctctgtggtattcgtgcgggctaagttatgcaggtgccatgttttcccgcggtctttgctatacataatgccggcgttgggcacacgggtagcgtcgataaactggatcgggaagaccaaggtaccgtcttgcatcgtgatgcctcgtcccgggccttgcaataggaaataccaagacgggtcttttacttgggaggtgatattgatcggttcgctccacgtcttaccatcgtcctcacttttcacgagcataagttgggcggtctcgtccggtgtcattcccggcatggagttccaccaagcccgttcgttacccataccatgcgtccatgcggctactacccagatcgtattggtcttttcgtctaccaagatcgatgggtctcccacgccgttttgtccgtggggcaggccatccgtttgtttgaaagtcatggctactcgcatcggttcccaagtttgtcccttatcggtactgcggcttactccgatatcgattttctcttgcaggtccacgctgctattatagcgaatatcgtagactccaagtaatgttccgttattcgtcgtcactaatcccgggatgcggaaggccgccgatccgtcatccccggcttggcgtacgccgatacctacatggcgttcgtccacctttcctttccaagtgatgtcgatcggtttgttgttgatctgtgcgttaggcatcgtggtcgctacttttgccaataaggaagtctctggcttcatctggatacttacccagaaatagttgatgcctttaagcatcggttgcttagaggttagttttaccgtgcgcgacaagggggcggtaacctcatcttgccgtacggaataagattcaagagccttacgggtatttcccggtatatggctggatatgtacgtaacgggactgaaatgttcccctttgcgggatggagcttccactccgctataaaatagacgtatcgcttggatgtccgacaggtcgacattgtctccgatctgtatcgtgatctcgtttaatacatcccctttttgggccggtatccgcatctcgtaaagtacattgtcgatccggtctatcaagatggggatttgttgctctcgcacataaagactgtctgccgcaaaagccgtttgtacgatgaaaagaaggcagaaatacaggaaagtttttttcatgatgttttttgtttgtaggttgaaattaatagatatgtgaattccaaaggtagcgatattcattcatatgaacaaagcccctttggaattcgtgccaaaaacctagttatatccaatcgccttaaacctatgtacgattagtatccgggagtctgtttcaatgcggggttgtttgtcaatgccccttcattgatcggccataataaacgtgattcttgtgctgtggtatattttaatacataatccttaccgaagcgtctcaagtcgtaccaacgtttaccctcaaagaagaactcgcgaagtctctctttaaggatagcttccatcacattctcgtcgcccgcctcaaacgggttatcgttatagaaacttcctttgtcattcggataagccacctcgttcttatgtgcgttaaaatattcggaaccgtaagcacgctcgcgaacggcgttgatctctgtagaaggatcttctccgagcaaggccttagcctcggctaataatagcaaggcatccgcatagcgatagataggataatcatcgtaccaacttctttcgttgctaccttccaaggtggttccttggaacttgtattggattggtgcgatatattccaaggttccgtcttcgtgctttttgtaaaccgccttcaaggtacctttcaagcgggtatcaccttcgcgaaatgattttaggtaatgatctttctttacttggtagcgcattaagccttgtaggttgtatcccggtatttcaaggaatggagttcctgtctcgtcacagtagcctgccatgtactcacgttgaggtaccatattgttacgccagttatagtctctccacatcatgaaatcatcctccttaccactatggagcgcgaagatcatctcgctgttctccttattgttgaaagagaaaacgtccgtgaatttctcttgcagctttaagttgccgttttgttgaagatcttgcaaggctgtcttggctacggtataatcgcccgtgccgccacccatctggcgtccgctccatagataaacctcacctttcagcatcaaggtagcggttttagaccaataacactttccttgtttataagaataatctccgccaaaagctttttccgaggcatcgatatccttcttgatcagatccatcacctcactcgctggagaagcggccttatcaaggtgagagatatccaattcgctacctaaggttggctccgtagtaatgataacgtctccccaagagcgtaacaaatggaaatagatataggcgcgtaaaccgtaagcctgccctaagtaatagttcttttcggcctcgcctaataaatcggtctcgttcgttctacggatcatcaagttgatttggttcagtgtcgtataaaaattagcgaagttgctgatacctgtaaactctgcgttgatcgtgttgtatgagaaacgctctacgccttgggtagcctcgcctccgaacggctgatctccgtagatgtctgagcgaggttcgcccaatacgaatatgttataactggattgtgaacggagcaatccgtgtaaacctatgttgaatgccttaaactggtccggggatttccaatagtttgcgtcggaaatactacttacgggttccatgtccaaggagtcgcatccgctgaaattcagtaatgagactgctgccatcatggctataattatctttttcataaatgtctgtcttttttaatgggtttgactaaaatgttacggataaaccaagaagaaccgttttaggagttgggtatctaccgttatcaagaccttgaccataggtagtatctaccgccggttccggagatacaccggtatatcctgtgatgtagaacaagttttgtccggttacataaacagaggcattgctcatcaaggctttgttaatccatttctttggtaggttccaagtcaatgtgatttcacgtaaagctagataatcacccttttcgtagaagcgggagctgttgttgtcaactgctgtcaaaccattgttggagcgagtaatattcttcttactcaactgatcggcatagtagaacttaggtatatccgtattctggtttgtctccgaccaactgtctttcaccatatcgatgatgttaaacgaaccttgatattgtccaagtgaacgtgcggctaagtcgttatacagcgtatgccctaacgcataatcaaaacgagcgtataaagagaaatctttatagcctaatgtcgtggagaaaccaccggttactgtcgggaaaagattacctactttcacgcggtctagattgttgattacgccatcattgttcaagtcggcccaacaaacgtcacccggctcgatcggttgcttacctgccttatcctttaaagcttcccatgcggcggggccatacaattctccaattgcgtcgtagcggttattggcattcgctttcacgtcatcccaatccttgaagatatgatcttgcttgaaggcaaataaatcacccagcttaccaccttcttgttttccgccaacccatacgacttcacccttttgcgggtcgtatacttggtaacctccttggcggttattttcgttcccattggccggaagcttgacaatcttgttcgctaccgtagataagtttgctgatacatcccaactgaatccgtttacgttgtttaggatattcgcttttacttccatctcgaaaccttggttacgtaaagttcccaagttggttttgatgctgttgaaaccagtgtaattgggtaaatccaaatctgtcaacaaatcggaagtcgtacgattataatagtctaggataaagctcaggcgattgttgaagaatcctatatccaaacctacttcgaaagatttactttgctcccaacgtaatccaccgtttaccaatttgtcattatagaaacctacagagccatcatagtttgttatgatcgatccgttcgcgtctttctgcccatagctgccatatacgtcgtagtatcctaatccgtttacgttaccgttcacgccgtagctgatacgaggcttcaggttagagatcacatctaccaacttcgattccttaaagaactcctcttccatgatattccaaccagcggagatacccgggaagaagccccaacggttatcgctcaacttggagattccgtcataacgagctacgaccgataataggtatttgtaattgtagttatagtttacacgggcaaagccagaaaggatacgatagccttccttgtagctataggtataggtacgattactaccagcgttcaaagtagggatgtcatccgacggagaattttcggtccttgcgttcagcgtatattgatgccaattgaaatactcgccaccaagcattgcctccagattgtgtttttctttgaatgtgtctgtgtacgtcaaagtaacactatgttgctgttggttctgctttatatatttggcctcagccttacgggtaagattcgggctagtggcgttttgttgttggtaagatttctcgaacttatctgtttgatcgtctacgtggtatagggcgctattctctttcaagattaatttcttcgggatgatctctagatcaaaaccgatattataggtagagcggcgggttccattcgtattcgttaatttatctttgtagtaaagagggtttccatcacccgtgccgaagcctgaagcgggagatccgtcttccatgtatgggttccatgtagggcgttggctcattgtgcgatagaagaactcatatgatccgatccaaagacccggctggcgagaccatgtataagtcgttccagcgttgactgtcaagatcggaaatatcttataggatccattgaatgtcccggagaaacgctcgtagctggttcccttaatgagaccgtcttctttgtagtaacctaagctggctgcgaatgtacctttgtcgttacctcctgtgatattgatataatgatcttgcgtgaaagaagggtcttggaaggctgcgtctttcatttgccctgagtaatccttgaataagatttgtttattcggatcggttgggtcttgcatttgttgccaaccttctgccaagaggcctttggtactgtcatccaaataacggatatcaaataggtcattcccgataccgtatcccatttggttatccatgcctgaacgtcctgttctttggtatcctaagcgattgtagtaaatataatcgtgagcgtttaagtaatcataacctgtgcgagcaaagttggcacctcccttgaacttgtaagagacggaagcggatccttctttaccacgtttcgtggtaaccaagattacgccaccattggcacgggcaccgtagatagcggttgaggctgcgtctttcaatacttggatagactcgatgtcggaggggttgatgtcggccaatgagttgcgcacgataccatctacaacgaccaatgcgccattatccttacctgttatggtagctccgccacgaagtacgatatttgggtttgctcccggctgaccggtcgtgtttacgacgcgcaaaccagatacggttccttgcaaggattgtccggcgttagacatcgctgcgttttccagtacggcgttatccaatttagagatagaggttgtcaaggtcgctctcttttgtgagccaccgtaaccggttaccactacttcgtctagctgttcggcgttttcttgtaggatcacgtctactttggctttcccagctactggaatttcttgtgtcttgtacccaatgaaagaaaatactaatgtggcgtttttgttggatacggtgagagtgtaattaccgtcgaaatcggtaatcgttccatttgtcgtgcctttttcaacgatagacgcaccggggacacccatgttataggtatccagcactgttccggagactgtctgctcttgtccgtacataaatgccggaagtaggagcgcaagcattaagagcagtagattcttcttcataatgaattacttttttgttgtttatttagtttattggatgagattaattagcattcgtcggtcatattagcgactttcggacgtaagaagatcacttggattaaaagtgcgatgagtaccaatccggctagcatggcgaagtcatggccaagattaccagcgtcggtagattttcctagtatatccgtgatggcggctccggcaaatacaccggtcatattcataattccataggctgtagcccgataacggggggagatgaattggcaaaggataggcatattattggcgtcgaatataccataaccgataccgaagcaaagaccaccgccgataatcatcgggaagttgtgcccaaatcctagtaataggagagagggtatcgttaatgccaaaccgatggcgcctgtgtatacacgtccccggacattccgctggatccatttatcggataaaatacctccggcgattacccctataaaggaagagatagcgatcgtgaatgtagataacggaccggcctcggacatatccaacgagagattttcagcgaatagggtagggagccagttctttgtcgcccaacccggtaagctcggcgtggcgaaataaagaagaatgatccaaaaagcgatgttcgtgaataacatccctaatcctttaaacgtaccggaaatcggattctctttcggataattttccagttttacggcttgttccacatgatctttcttatcgtgtaagaagatgatcaagaccacgctataagcgatgccgatgataccaaaccaatggaaagtcgtttcccacgtataagcactggccaccgtagctccgaatccccccaaggcttggcctacgtatagacctgtcatatggatacctacggctaatgagcgtgttttctcttggtgataatctgtgataagcgataatccggcaggaatatacagggcctcactgacccccatcaaggcacgtaggtaatagatctgattgaaatccgtgcaataccccatcatcaaagtcacgaaggaccagacaaataagctacccacgattagccacttcctgtttaccctgtctgccaccataccggccacagggctcatgaatccgtagatccagaggaagaccgccatcaaacgtccgaagttcgccgcagactctagttccacgatatccaccatcatagctgatttcatggttgatagcatctggcgatccatatagttcagtaaggcgacaacccatagtaaaccgactacgatccaaggatataatttcttatttttcatttgattgaggaaaataaaaaggaaaacaaagccttagaaacatcaggagccacggttgtgacccctgatgtcaattgaccaattttcagtattttagataaagttatttagaaagaatttcgtcgcagagtaaactacatttgagaagcattctaggaatgtggaacggacctttgaatagattgcctttggcagattgagagagactaccatcgaagtgtaggtagccataccattccccatattctttgtcggggagatgattaaatgtgtaatcgtttattagtttgtgcatttcgagatatttggcgtcgccagtcgcttggtaggcgtaaagcgtagcgataaccgcctcgcattgtggccaccagaacttcatgtcgtgccaatactcttggggagggaagtttttgcaatccttgaaatagttgattccgccgtacgtcttatcccagccccagtcccaagaccagttgaggatttgtaagcccatctctttcagttgagggtcccatcctcggtatttggcctcttccaagataaaccatgcggtctcgatggagtggccgggattgatggtacgcccggcgatagagtcgataaactcaccgttgggtcctactgtctccaagatagccttgaattcgggatgcatgaaatcacggcgtagctcggctatggaatcatcgatttgttgtgtaagtatgggatcgtttatggcctcacggatgcgtgccgccgtatcgatcagtatcatgcagaaagaatggcctttcgccacgagaccttcacgaaatttaggctccaataatcccggggtattcttatagtgtaatacttgcttgaataagttcacggccttctcagcatagcctttgtcgcctgatgccaatgcatagtgggccatagcgatcgccgcaaaagtctcggagaatacgtaacggcgtttacgtacagggatgcctgtcgctgtcacctcgaagaacatacgtccgtccgtatcaaaacaatgtttctcgatgaaatcgataccgtttttacaggctctcagccattcttcgttcttctcaatgtgattataggcatatgccaagataaaggcgaatcgtccttggaaccaaacggatttagtggagtccatcagagtaccatcccggtctacgcaagtaaagtaaccgccgttctctttgtccagtccgtatttcatccaaaaaggaagaatattggaaagaagctcattccgataggtcttgccccaataagctagatattccgatggattagataaattgtcaaacgctgccataccttagaatttattacatctttcaaagaaattgatagcctctaattccgctttcattgcggcctcttcttcgtccgtcatattccggaacggggtacggttcttgccgagatctaatccgatcaatttcatgatgcgttttcctccgacgatattaccacggtaattgcagataacgttaataacctcctgagagaagttttgtctctcgcgagctgtctctaagtcaccggctgcccaagcctctaggataccggttaattcttttccgttatagtttgtggtaccaccgatacctccttgcgctccacccatcgcaaggcaaggaagaatcgtttcatcctgtccgtgcaacatgtcgaatttaccatccttgtataaacgacattgattgtattcgtataagctctcgtatgtatatttgataccggcgaaattagggatacgcccgtctactgcttttaagaaatccagcatagggaggaaagcgttgttaaacgcagggatatgatagtagtaaaacggtaaggcaggagcgccgcaagcgatctcctcgcagtactttaccaattcctcaattcgaccgatacgagggaaaggggtagccatagcgccaataccccaagcgccgatcttttgagcatgttccgctaaattacggctagacttaacgcatgtgctacctacgtgcacgattaccttaaagccttccggagctgcttccatccatttctcggccaatttcatgcgttcttcctctgtcagcatataaccttctccggaagaaccattgatgaatacgcctttcagcccgtttttcacaagaagtttcgcataatcttcaatgggctcgtaattaacttccccgttctcgtagaacggagtaaagggagcatcgatcaatcctttaattttatccatatctgcgttatttttatgagttttaacctctgattttaattatgctgcaaatataaataaaatattttaataatataatggtgctttatcgagaaaatgaaataattatttattttttatttaattcctttgaaatacatattaaatcatacctagaattttagatcgagatagcaggcaggctcctaatatacccgctctttcacctaatttggatactttgatctgagtatcacgggttaccaagttcaaagagtacttcctgacggcacttttaataggtaggcttaaatattctcccgtctgcgacaaggggccgcccagtacgaccagttccggattgaaaatgttcatcaatccggctattcctttacctagattaaaaccgatctcctccagtatctcaatggatagcatatcctctttgtgaatggcgtcgatcaagtcagagagcccgatgtattccccggcatcgattttactggccaatatggtgttgctaccctctttataccgctcaaggagggtacggtatagggcagaaccggaagctccagtctcgaggcatccttttttaccgcaatggcaaagaatctcattctcgaagaagctgaagtgcccaaattctccggagaaacctgatttcccgaaataaaccttgccgtctatgatgataccgatacctaatccccaagatatattgatgaataggatatttttctctccttttacgactccttgaagatattcgccgtaagccatggaacgggtgtcattctctatatagatctttatatgtagtttttcctcaaggatttgagacaagggcttctcctcaaagtaaaaaatgctatagctatatccggcgaaaggatttacccgtccggatatattaatgccaatgcttaatatcttttcccttgggatcggcaacgagtttataaattcattgatgcattcgcaaagatggtctaaagcggctggtgtgttttcgagtgtataagggatattctgctcaatgcggatcttatctcctttaaaatctaatatggctagattcagttgatctttcagtatatctacgcccacaaaatagccggatacgggattgagcccgtaaatactaggtttacgccctccgctagtctcttgttttccaaagtcgagtatataaccgtcctcttgtaattcgctaattagcttagtgacggtggggatactgagattcatttctttacatacctccgctatagtagcgtctccattggccatataataatgtatgatcttctttttcagaaggccactgcgagtattgtcatcggacgagagcaagaacttagttgtcatggttatacctttattgagtgattagggcaaaggtacaataagttttttcaaaaactaagcgtaataaaataaaattttttcataaggagctatcttaattgtaagaatttgtaatagaagttgaataccatagtctgcggcggactctgtcactcgtgacatctgtgataaacgcataggaaagaaaggataatattacactaaaatccttctttcacgatccgtttgatcgggaggaagaatcgttcgatcaggcgtaattcttccgttacgatctccgcagaggcttgcgtctcgggcgagacgggcaggtcgataccgtaattggttctcaggccctctggaaaatcgatatccgccgtatagtactcgtcggtggggaccaatgagatattcgataccactccgtttaccactccaaactcctgatccgggaaattggagaaacggacgatcgcccgctggcctctccggacttttcccgagcgtgctatcggtatgcgcactttccccaccagccggccctcgccttgcggtacgacggtgaaagccacctctccggatgggatatactggttctcattccagtacttggtgaaagtcacgacaccccctaccggggcgatgaggcaataacgcaacctccactcgttcatgctgttcagcaattgttcccgggcggtctgtaattcctgccgtagcgtaaattctttctcgctccgctccagcgtcagatccagcaaggattgctcttgctccccgatctgtatcctgagattctcagccgaggctgccgccccttctagcgaataacggctttgcagtagggaagcccgtgcggtctcatgctcgtaggaggaaatcacggaccggctatacaataatgaatcccgggcgtattgccgccttgtcaaggcgaattgctccgagagggtcttccgctgccgttcggtctcgttatagtaagccttatacaacgctatctgtttgcggatggaggtcattttttgcggataataatcgatctccctgtaattgatacaggcatggagcgccgagagtagtcccgagtaagccgcttgcatatcacccagcgatagctccttgtactttgataatgccttgtccaagctatccacgtcgcttccggatcgttccaacgccttatccagatagatggcatcgtccgtgtcggcgtgattctctatgaccgccagccaatccccctgccttaccggacgattatccctgacgagcagctcctgtatctttcccgccgcccgtgtcaccaccgccgttgcgggatgttgccccgtcaatgtcatgtcagccgtgatcacgtcaggatacttgaagaaacagctccccaccagcaacgctacgaccacgaggaataacagcgttatcccccaccgtacgatccaggccggcacttgccccatcacctcctgtacctcctcgctacgtaactctatatctttattatttttcataaggtggtttatttcgtttggtggtaactacgataatccctcttttcccttttggaccgtatatagcagcatcaacaccttttaggataaaaatttcttctatttcggtcacaggaaacgaaagtatatcataattttgatatggaacgtcatcaacgacaaataaaggtggctcataattttttacaggatccgtttggaatgaaatggctccataatcttgaataaacacacattccttatacacatgatctactacataccacgaaatgttaacactccccaatagataaagtaaggacctcatatcctgtatatgccattgttctatgttttgtcgatagattacacgactggatggcaaagatccagaatacaatccattatatttttgttttcttctcatgcttgcgataatagaaacttcatcgagatttacggttttccatatatccggatttggttgtgataagtttttaatgggagtaacctctaatgtcatagctattaaatcccaggccaaactcaatcgtgagggatctgaatctatttggttcttaagtggaagcaatcccattcggaagtctggaggcaatgactggaaatcagtctgttcttgtatgtttagtacgacacggccacacaatagattcttcatagaatctactaaagcgaacgaggatatcccttttggaaaatgttttttgtcaaaaactaaataagaatctttaggattccagactttttggaaaaaaatagaatcttccgattgggccactaaatataataatttcattggcacttccctcgaagagttgataacggataagaaccattgttctttattttcaattattttaagaccaaagccattttcactcatcattggcaaataaaaattcttacggattctatctcgattttcgcattttaagatatatctttctcctggatttgcataaatatgaaagtagcctattccgggcaatagcgttttcacggattgaaccgtatcccctctctcatttataattactccagtgatggatatctttttcttgtcaattccttccgctgtaaaaactattttacatgagatattttgaagaatagatccactttcaggataaaacgtaacaatatagtcggtctcccgttccgatgcagaaacgggagataccaaaaaaagaatttggataatactaatgataatagatttcataaatttatatattcattagtaccggcaaatcaggtaagcgacgttcagggcacacttctatgttgggagaacaagttccatagtttctagggcaattagtaccatctcgaaaatttccacatggatcagaaatgccaaaagccgcattacatgagtatcctgttgctccacaatttgtattacgctcgttacaaggccgtcctcctataagtttagccattgtaaattcatttagacggcttttttcaatcactttaaaatttttcataacgcaatgatattaagtttttaaataaatagcctttttattataatcttattcagctattttgtgacaaatgaatttttataaattctttgagagaatccttaaggtatgtacatgtatcataatgtttatctttaaatatattttctatccgtttatgggggcaacctccaaaacaaataggaagataaggacatttagaacatgttttatcttccagtggatctgcggcatagaggtatcggttaagaattttctgatctatggattgaatagttccttctgaatccaattttgctatggcatatttttgatcgcctataatttcccaacatttatataagtatccttctggatctattgtaaatgtgtgtttatttcgaatagaacattctgtaaaagaggaatctggatatccacataaattggttacgatacctctgtcatagtagagctgttgtataaactcagatttctcttgtctattgaaaagtaaagaacaagaagaacttgatttagaagaagtagatgttataaaagcaggataaattccaatcaatgggttgctcttatatcgttgtaatatgaaagaatataaagttataaattcagaagaattctctttattcatatttactcgtatactaattcgtatttctggggcagaagatgctagcaagtctatattctttatagttctagaaaaagtatcgttttcattttttgtgaattttatcttgttgtgagtctcttttaatccatctagcgtaatttgtatgtgttgtaacttcatctccttaaagagttttataatatccggtgatatcaagaacccattagagattattgagaaagaataatttttatcgggaatcagaatcatcttacgataaagtgattctatttgcttaatgcctagaagaggttctcctccaaaccaaactacgtgaatatttttaatgttttcatattgttctatgaatttaataattgagcttatgaccttttctgtcatataaatattacgtttgcaattttcaaaacagtaagaacacgagtaattgcaatccatggttggagctatcgttagatttaagatattgatggagcgtcctgctaggataatacttttatacagtaagaactcatcccgatcattttcagtgatcatatggttttctttcaaagtttgataaagttcatcacatcccaagtctttctcttgtaaaggtgtatgtctattcttgttgactaataaaatcttatatgtatcctctgctatttcgatcaaggcattagacaatgtattatatgcataaaatttactgtctatctcaaataggaatgtgtacattgatattttcatggtatttgcatatttagattgttaagtgattaattccccaactccaactggttcttcaccaacttataataagtcccccgcaaggccgtgagctcctgatgcgtcccttcctccacgacgcgtcccttgtccagcaccacgatcttgtccgcgtcacgtaccgtgcttagccgatgcgccacgaccaccaccgtccgtcctttgtagaaggcgtgcaactgctccatgatctcccgctcgttgttggcgtccaaagcgttcgtggcctcgtcaaggaagatgaagtcgggattcttgtacaccgcccgggcgatcaggatacgctgtctctgcccttggctcactccgtttccctccatgccgatcttcgtattatagcccaacgggagagaatcgatgaaatcccggatattcgccaccgtcacggcatgcagcaggcgttccttgtccaccacctcttcgccgggggcgatgttgttggcgatcgtatccgagaagataaaaccatcctgcataaccgaaccggtcttgctacgccatacgtgaggattcaagttcttgagggaggtatcgccgatcctcacatcccccttgttggggttgtaaaaaccgagcaggagtttcacgatcgtcgtttttccgctcccgctggcccccacgatggcggtcaccctgttatggggtatcgtcaggttgatatcctccagcacgtaatcccggtctgcgccgtcatagctgaagctgaggttttccagccgtagcgtcctgtcatcgggaagaacattcagccttatcccgcctgcctgttcctcgtcctccttcccgtgtatctcgccgagccgctccagactgatcttcgcgtcctgtagggatcgtgagaaatcgatcaattgctcgataggcgaagagagctgccccacgatgtaggtcaccgacatcatcatacccagcgtcatatccccttgcacgacggcccgcgccgcgatgaaggagatgagtatgttcgtggtctggttgaaaaagaccgccccgagttgctgatattgttgtaacgccaaccccttgatccctatcttgaaaagttttacctgtatccgttcccatttccatcgcatcttggtctcgcaattattgagcttgatctcctgcattccggtgatgagctggaataggttgctttgctccccggccgcttgcgagaaacgctttacgtccagctccctcctccatctcatgaaggcgagtacccacgccacgtataagccgttacccgccaagaagagtcccagtatggtccagtcatagtaggcgagcacgaacccgaacacgatgaagttgacaaaagagaagagcgtattgatggatgtcccggtcatgaaagcctcgacgcggtcatggtctccgatgcgctgcatgatatcgcccaccatcttggtatcgaagaaatgcaggggcaggcgcatcagcttggcgaggaaatcggagatcaaggcgatattgatcctcgtgtttacgtgcagcaatatccagctccgtatgaagtccacggatagcttggcgataaagatcaccaattgcgatataaggatcaaggttatgaaacctaggttgttgtcccgtataccggtatctaccaagctctgcgtgaggaaaggcaggatgagttgcagtacgctggctgtcaccatgcccagcacgagctgtgccatctcccgcctgtagggcgatatatatcggaaaaagaatccgaggttacgtttcctgtctctctcctcgtcctccatcccgtagaactcctgccccggttccagcaagagcaccgtcccggtatcctgcccgtccaccttggtactgacccagcaccgcttgaactcctccctcgtataggtgataagtcccgccgccgggtccgctatgtagaacttccctttccttatcttgtagcaaaccacgaaatgccattggttccagtgcagtatgcagggtaggggacattccttttccaattcctccaccgtgatccgcacgccctgtgttcggaacccgatcgcttccgccgcctcgctgatacccagcatggagactccttcccgtgtgatgaaggctttctcccgtaagttctggatcgagtacacacgaccatagaacttggcgatcatacggaggcagctaggaccacagtccatagaatccaattgctgataatgtggaaacgatcttagcataaattaaaacattaggatatagacatgatttagttcttatttcttatacttgatcagcattatgacgggattggaatcctcattcaatttcgtcgcgatttcgtttagcctacctttgagcttcccttctttataagcctcaatcagttcaggcgcatcaaagggataccagttcgcgatatcttgattaatagatgaaatccaatagatcggtctttgatataaaaaatcagtattatatatttgatatttgaatatagaatcttcctgtttgtcgtataccaacctactcaccggtatttttctcgttttaatatcgagttttttttctacggttctcataaaataataacggcttgtcacctcctctacaaaaagaaatatttctgtatccatggaatatatagagggtgtcctcacgataaaaggtttaatatgaccatttggcgaataggaatatagggtatcggatgagagattcataagtatccaattatcggaagtggcggttgtagcaaaaaaagtaggaattactttttgatcattatctccgaatataaccagtgttttctgttctttagaaggaattgtaattttctggataatacttccgtcatactttgagataatcaaatgataaggctgttggtctgccaccattccatagcctttgttatcataagtgatcagattatccttgtcataattaaaaaccttaaggtagtcactctcggggtctaggaaattaaagcttcttttaaagtccccgtctaaatcatatactgatattttccctgtatgtgtaacaaatagctcattgttttcctcatctagtgtaattcctgcaatccccggatattcttcgacaccttgtcctaaacggtttattttccgtatagctttccccgttttccggtctaaaatgaatatgttcccgtcgtttgtgttgttttttactattataaatttttcgccgatatccatgacattaccatgtgtgataaattcgtcagtcgtttccagcgcaatatattctacatccataatatcctgaaggattagctccttttctgggtaatctttgctaacattgatcgtgacaaactcgtctgtcgattgcttatcttttccacatcccgctaaggcaaagaggaggactgctgaaattaaatttactttcatgctagtatttatttttcttgtgttttatcagcataatcaccggattggactcttcatccaatttagccgcaatctctttcagtttgcccttcagtactcctctcccgtaagcctcggcaagttcgtgggcttgcaatgactgtccgattacgaactcctcatctaaaggtctcgacgtcatatccacttctcttttgctggtataatcaccattgtatattttaggtatgaataaagaattttccagtctatcgtacatcaatccggaaattggaaaccctctccctgtttcaaaattaaattccgctttcaacaggctcatgaaataataacggtcggtaaaaacggttggtataagaaatacttcaggaggatccatggagtgtatggagggggttcttacgataagggggattgtcgtattagcatccggcaaatagtggtatatggtatcggatgatgtctccataagtacccaattggtatgatctggaactatttggtacacagcggttggaactggaacagcccaagcttccccgtctcttgcgaccgggcttttaacttcatcaaaaggaattgatattttccgggtgatacttccatcctgcttggaaaagattaaataatatggaggtatggcgtttgacgggttttccagactattatctggtacataagagatcaaattatcccggtcgtaattaaatgtatttatatgagattccgtaccttcggctttgaaactccttttaaaatttccgtatagatcatatacagagattttacttccggtataggctataacaaatatttccttgtttgcttcatccagaacaacctccgtaatacctacatattcctcgccaccttgccctttcctgttaatcttcttcaaggctttgccggtttttcggttaaaaacaaacaaattcccgtcgttggcccagttggttattaatataacttctgcaccaatggccattactttgccttgggtaacaaactcatcatttgtttccaacgggatgtattctacatccatgaaatcctgtaatatcaattccttttcaggataattctttgtaacatcaactatgatgagttcatttgtcgattgcttatcttttccacatcccgctaacgcaaagaggaggatcgctggtattgtgattatccatttcattattcttacgatttaaggttaaacacttagggcgatacgttcgctcaatcatgctaattacaaaaataggttattttttctcgacatctcttctttttgctcaaaacttatagcggtgaatggaattctatccgttatttacataatttaggcaaaggcttagcaatggatgttgtttcctctcgctatcttgtgggtcacttatcgaaagatcgaatagttcgcttatttccgggtcgttgattcccggatcatccttttcggactccagatgccagctgacccatgtttgtccttccaacttatccagatcattctctagctcataatgcaatgtgggaaggtggaaaacgactatagtcgcctgttggaaatatttcctgtcggtggttatcacccaatcaacgggtacatcctctattttcaactgtagatcttccccatttatcgtgttgaatacgagcatcacttttttaccagcctttacttggcaatctacgcctgctacctaatcagacacacgccaatccgtatattctttcagcccggcttctgccttgtagtaataatttctgcatctttgtatagattccggaatcatttgcccgcaatccctccaaaatcgatccagataatgtttgtgtactatgtatgaggaatctttcatgttgggaagtagtgtgaaggccatggaataaagcctgaggatgtttacataccaccagcttctcaagtcaacgctcgtcttagaggaaacaaattgatcagagaatttaatcaatccctcagtaacttgaaataatgatttcagccttcgggctaggcttgtcgtatgcatgaccgattcttcgttctggcggtaataataaaactcaatgttggtgataaccatcctctccgcttggcaaaggacgatgggacaccataactcatcctcatgcatgatgccttcctcaaaacgagcctgcattttatgcagatattttcgattgtatatatatttaacaggggtaggaaggtaaaaacaagttctgacgagccagatgaaaccctctttcccggaaagtaccttatggggcgattcgccggaaatccatttgaagggttcatttatacttccatcttgatcacataaccacatattccccatcactacgtcggcctgatatttgattgcctcatggtataatagagataatgagctttcttttatccagtcatcgctatctaaaaaagcgatatactcaccttgggcaacatccaaacccgcattacgggcagcagacgctcccccgttctcttgatggatcaccttgatacgatcctctttttttgcgtattcgtcagcgatctttccggacaagtcggtcgatccatcatccactaggataaattccatgctcaaatcaccttgacacatcaaggaatctatgcatgcaaccaaatatttttccacgttatataccgggatgatgaccgaaacctctattttattatctggcttactcatggccataaagacttatagaacgtcaacatgttctccctaaatacctcagaggaatatttttccaagtatcgcttgcggccgtttttaccgagacgtttcgcttcctccgggttttgcagcaggtacaagatcttttctgccaacaaggagacgtctatctctacgctatcagaagatacgataagaggtatttttaatgcgcaagattcgtctactacctcgtttaatccggaggtagcggtcgctataatgggcaattcatgcatcatcatctccacagggacataaccaaatggttcgaacaaggaggggacgacaccaacatcggctaaacgatataactcatataaatcttctttatttaaaagtcccgtgaacgtgatcttggtgaagaacggtttagcatttcgcaaaaaaagatcataatttccatctcctattatcatcaagcggctttccggataatcctccaataccttcataaaggttctaaccaaaaaatgcccacctttaatatcttccatacgcccgacaaaaagaatgattcgttctttttccattatatgccatttctttttcaaagtcttttgatcgacagactggcctgtcgtagcatcattcaatccattagggacaatcactatcttgtccggatcaagtccataatcatgcgataataagtcttgcatatagctggataaacagatcacgcgatccatcttcatatagtccgctttttcctcctcaaaggcgtatcgtacatcctcactccatacatctgaacggtttccctttaagattgcccgtagccgttgtgggttatcatggattcccgcagtccagtccgatgagtgcgatacggatatgaccttacaatcaaaagcctctctcagttccgttgcgagatcctcgttttgataatgattcaggtggaaaaccaactcctttcggtcgcggatatgaacccgtagcaaataaacaaggttatggaagtacaacttcctttgttccttatccaaaaaattccattgttctgagcagggagttgggaaataccattgggtaattccttccatttcctctttccgtacacacttcccgtcacaaagtatgtttacaaggaaaatccgtataccactgctttttagggcggttgtcaactcatggatataggtaccgacaccaaataccgtacctctgcttttctggcttatgatatatagattcatggcacaattctttagataaaagttttccatgaggaatccatcgcccccagttcggttaataaagccaacccttttccagcgtaaccagaaaggagccccatagaaaccgtctcttttgcttgagataaatccgaattatcctctcttgatccatgctccatcgcaagagcagaccgttttagcaatactggcggtatatttaaagcgggacaaacccgcaatccttggaagaacctatatgcgtcttgccattcatcccagtctagttcttccgatgccatctcgatccgttccacgatttgcgacaaactatccaatgcccgcttggaagagaaatttcgccgtaatctagcgagccaatattccccatatccacacattccctcataacggctgaaattaggacaaggatcataccatacggctcggtacattcgttcgtcaaaatcatcgaacgcctcctcttccaaatccaggaaccttttttcgagcaggtaagaaaatccaacccctatgcctgctatccctttctcgtaatccgcccgataattggcatgtagctgttccaacaatcccctgatcagatccatggcgtattccgaatacaaatcgtcttgtacatatcgggcataatggaaaaagaaaatggaaatccccatctttccgtgtaataagctcgggcattttgttaatgtgccgttcaataagagttgattggaaatcagactcaattcctcttccttttccatggcattatgtggattttcgattttacttcttatatttggctatcatgataatcggattatcttcttcatcaagtgttgaggcaatttcttttagtgggccatctttcagctttccatcttcataagcctctactaagtctgcggcttccagttttttcatgaatgcaacatccttgctgttctggaagtatagacggtcatgaaaattgtaaaccatagtcattggctccatttttagaaaatcattattatacatctcgcattcgtaaatagtttctttttgtctgtcatataccaattctacaacagggaaaccgacttccttttgggcattaaaaatattttctaccgtttgcatgaaacaatagcgatccgtttggacacccggataaagaaaaatcttggtttccatgtcttgaattgatggggttcttacgattcggggtatcagttgttgatttgaggtataatggtagatcgtatcagatgatgcttccatcaataaaaagcccttatcttgataaggtatttgtgggctgttataaatacaatatataatctctccttccgctgcttctgcggttaccagtggataaatattttttttgtaaggtatcgagatttccttgatacttccgtcttttttagaaacaagcatgaaatagttccgtgttgccacaacttcatctttcaagctaagataaccgtcatgacaaagtagatagtcttgattgaaattctccagcttatcataatagaaattttctttttgatttagtgatcgcttgaaattcccatcttgatcataaaccataatttttcttgaaacataattgttgacaaataattctttttcttttagatcaaatatacaccccaaattgatcgtgtactcctcagctccttgtccgagccggctgatctttttaatacctttcccgtctttcccaaaaagaaatatatttccggtattgttacggatggcatctgatatgagaagacaatctccttctatatcattgggagtgccagatgtgatatattcatctgatgtttccagtgatacatactcaatgtcaaaaagatcttgcagtatcagtattttcttagggtaacttatcgtaacgtctactgtgataagatcttgctcttgaacatttttattattacatgctaataaaagtagaaaaataagcgtatagctccattctgtttttctcatattcgaatatataaaagattatttattattaactgtacaaagattcaattgcccaatcataagatctaagtcagaaggtgaaggacaaatatattgatacaaacaatcgcagcatggtttttggttacgtatacgcaaccaagactcccctatttctatttctttttttacgatttgataaattgaatctgttttgatatttcccaattttttgtgcaatatattcgcataaatatctccatttgaaagtatgaaaagctttccgaaattatctttatttatgatatgtttccgaaaaatatctttcatgcttatctttgttgatagaatatcttcttctgttaagaaagtgttttttgctaaaaaagagatattatctttggtatataatggtcttaactgatatttatcaatatcatatttctcaattaaggttactgcttcattacaatcctctaaagaagtaacttgaaatatatactgaaaagggattttttgctggtcaagaaatatacaagtgttattcataagagaatgatctactggcaaagagacatatacttgatatgaaaaatttttcttgagtgatgattctaacaatggaatatgagtgtaagaacattgtatataatttgagtaagacatttgccccaaatagtctattaataaagacccatgtggtatatccttccagtcacctataatattataagttaaattaagagaaaaagaacgcaggtattctattaatgtttttatattaactgtgttgtctaaataaatagttatttcacagagtgtttgcaacaagttctcaagtgaagaaaactgatgtttatttttgtgtaagtctttataatttaaatatggtaatatttgcactggttttccttcggacaaagatacttctatgatatctcccataaatttagactgtagttcatttatgaatgttttaatctctatatcatcatatatatgttgtggcaataatactacaccacaatttttttcgcatagaatttcttttaaaatttggataatttttaaattgcaagtttttatatatttgccatctaatgtattatagagtaaagcttgtttgtttactatatttatatatacataaggttctattgtaaaccaataatttattttcataactttattaaattattagagatttaataatattgaaataatcaaaaggatatttctccaaaaaagaaaaaatgttatctatatgtttttcaagatcttcttttttctggaattctgggcattcaaattcgtgcgtacccaatttatctaaattatccaatgtaaaaatgcaaatggaacaatgtctacctgcataacaattagcacatatgcgcttgaagtaattgtagtaatattgatattttttagaaatcagatcaatatcaataattactttgtcatttacttttcctaaagaatgtttgtagcttactttttcgcaagggagtaagtcgttataggtattcatatatattttacgttgaaaaggagaacatgttcctgttggaattatggatacattttcatataataaattaagtgcattgtttagataaaaattaatagaataatttgctaaaaacttttttgtttttttgaaattcaatagctcttgatgcatgattggaaccaatttagaatcactttgtgtaaattcaatatcgctttgtgttctagaatgaaacatcttgtctaaattttctttgtttttagaatttacatgatctgtattcaattgtgcgatcattgggatcttgtggtaacgattgtaaataaattcatagatttcttttacagagttcaaattatggagaacagagttgaatcttatattcttgtcaaagaaaacgggatgtttcttatataaatagtcgatattttcaatagctttagaaaacgaattcttattgctatgagtaaatattctatggccttgcgctttacaatctccatccaaactgattaatagttgaaaatcattattaattatgaattctaagtttttttgaattagtgttgcatttgttgttagattgaaatgtaaatttaaacatttatctatattcattttttttgattcatttactattgtttctataaaattcgtattcattagaggctctcctccaaaaaatccaatagtaagttcgcttcctgttttttttatgctaaagatatacctcagaaaagttatggcatattctttatttatatttcttcgttcttttttgctaaaagtgtaaagatctcctagcgagcaataagtgcaatttaaattgcagtggtctgtcgtttcaaatactatttgttcgatatttttgatattatcttcgattgacacgtcttcaatatcttcaaaatctattttgtttgtatctgagaataaaccatgactctttagatattgatatttcttaaaataatatggatcaaacgactcttccaaacctctatttttgataactttctctaatttaggatgaatcaatatagataatgaaaggtttatatcataaagatatatgttctttttattagaataagatattatggtgctttccatattgaataattttagtataataaaaaagaggactgtcatataaattcaaatttaaacttaataggcagcctctttttcttctaagacctaatttcctccataacttgctgatagattaggatcatggttttggcaaccacacccaccctttagcaccttcatctcacgtttctcaaggtggttctcactaagcttattcagctttaagcttttcagcacttgttgcttcttttcgctcatggccttttcgttttaaaattagacaatatccatcacctgatggattgtatgtttcaaatatatacttttctatgcgtatattttatagccaatctgactgtttttttgtgtattggcttatttcttcaaaaatcctttctgaatccagctacgaattgtactttcagatcttcctgtagcgagtgcgattgatcggacactttgttttttgtccaataaggcttgtatatcattcaattctttattgaaagtgggatttgctgttgagcaataggttcctttcgcatatttctcttgtggagattgtaagatatggagataagagatccagtcggttgcttctcgcaagtcttggagttgtagttttttcttgatggagttgatatgtcctcttgctgtatgataacttatgtagagcttgtctgcgatggtagttatatcctgttctcctttggcgatcgttaagatttccatttctcgtttactcaattggggaatgggcaatatttgccaatcgcatttcattggatcataagtttggtatatgaggtggtcgtaaccgtttaggtaacatcctatttttttgcagtttgtatatgagatgatgtctattagataaatcgggttcgaatcttcgcagatggggatgagtcggtggtaagtatgtagctccaccggctcttttaggaaaggatattttcgtgacaaccggaacaggcagaaaaactctccccgctcatttgtgtcttctcgcaggcgatgtaatttttgtggcaaattctccaagaaacttttccacaacagccaatcttcgggatgaatcaccctagaaaagaaatcatatcctaattccatcgcctctttcacggaatggccgcacagaaaaagattgtcgggcttgatgtggatgaattgcttttgaacgatatccaatacatagaagctatcggggataagggaagagattcctttacaatattgaataaatgtagacttttgttctttggcgctatctgttattctttctgcatattcggaaaaaatatcttcaatggtattcataatcagattatttttaggttaattttttagtttactcatgcagactgcattgctgtgattcgctatattaaagagtctgttccaacgatattggaatggagcgtgagaaggtagatttgataagtaattcagttgattaaaaatttcgttaaggcaatgctcttgccaaactcgtctccaaccagcccatccggatacgtgggttaggttagaataatagtaagttccgtctcccctgtttttaccgaattgataattacttccggatatatgtccgatgcgttcgtcatttctgaatttttttagtaatgtcgtacaaaaaccaaagaatgaaagagagggtacacagtcatcttctagtatgattccttcgggctcttgctcgaagaaccaagaaatcgaatgaaaacagtgtttgtcgtatccttgattttttccctgatatagtttaaatacttggcattcccaatcaatgtgggaaacaatggacgttgtttccttacatattttacactgtgtgtcattagttgatccatctactgctatatatagtcttctcggtttcacctctttgatacgatcaaatacttgctttatatttgatcgattaaaggctataaggagaatcgctattttggggtcgtagattatcataatatgtattagttcttgattaatgacaaacttagtatttttgttaggttacgcttagaattcctaataacataattcaatgcaagcatccaggaaaaacgtatcattgggggcactgtacagtgattatcacgtttaacgatcttttttggttaatagtgatagatcaactatatgatactgtttaatcctgaagcttgcatatgataaagaataatacctaattattttgtatgatgaaatctcccgtaagctgccctaggcgatgttctaacactagataaaagcatcctgtgccagcctgatctaaagagatggatacacattcacctgcttcgccggagactacttcgttatataggatagctccttgctcatttacaacttggacagtcaaatcatctagagcatcgataaaatgtatgctcaatagatttccgtcgatggatactgttggaggagcaggagtgacagagcgataataatcgtcatgccattcgcctttggtcggtacattatctccataaacagacagtggcgaaaagaggccaaatagcatcaataaggttaataattttgttttcataatattttgtttttctttttgcaaagaaaagctttattctctaataacaatgaacatggatgaacaattggcattttcgtttttgttcattttctaacactgattataggtcattgatatatagatcgaaatcggaggcttttcctgttttgccgctcatcttcagataaagtctttttcgtaagactgatatattactatggtttaataacatagaaagacgtgagggtttcacatggattctcactaaatagcataaccgttccatctgtatcggtattttagggtaagcttcttgaagtttttgtgcaaaagacggataaatagcgtttataagatgaaacaactcttcccaatcctcggtagatggtttccaatcctcgttttcatgaaagttttatatacagatgaattcttcaaattctgtaatgattcaatctgatgctctttttgggcatataatgcttggttcttttgttcgaactcctgccgtagctctttcttgagttcttcctgttctcgatctttctcttgtaaagatttgtttaatgtctctatgatttgttcattatgctctatctgtttttcatatgctaggactgttttatcataagagaaaatcttttcccggttttctttttggattttcaataggtctttttgtcttttcttgtacttaaacaaaagataagtggttggtagaattatgcagagagcaataagactgattacggccatccgtaggttcgcataggccgttcttactcgttcctccgctaaggatttttgtttatcctgttcatcgtaaaggacttgtctgcctctaatcgtattcgtgacttctatctggtcgagtgtatcacgcatcatttcatatcgttgattcaactccgcataaaggatccattgttttgtcgatagggctattttggatagatgataaacagcccctgctctcgtgtccaatcgcaccgctttttccgtgcattgttccaaatagatttttgctgaatctaattggccgcaatgataataatatttgcctagtgtcaaatagaacggataaatgttatttcccaatgcctgcttgtttgccatgacctcacgaagtagacactccgcttccgggtaggtctttgtttctatatacagactcgataattctgaataaacagagagtaccttcctgctctccatcaaatcgagagttttagaataacaggcgatagcgctatctttttgatggagtatcttataaatacgtcctagatctcgaagcgcatagacttgaccgatagaatctgctattgccttgaaatgcatgaccgctttttgctgataaggtaaggctcgctcatatacgtcttgttgggtataaagcatcccgataccgttattaatcctccccagtaatgcgtggtcttcaatctgctcctcattctgtaaggcatttaagagacactcttgcgctttcaatggatgatttaggttttgattgatccgtcccttatagaaccaagctttcgcttttcgttccagatcgtctgtttcctcataataatccgtcgcaatcgtgatcagcgagtcggtttcatacttaacaaaagtcttgtcttgtgcttctgttaacagcaaataataatgtgccttatcttttcgggataggttttctttgttctctatttgttcaaggagcattaaggcgctatccggatgttggggcataaggttctctatttttcggaagtctatggtttgatggcccattccatcgcaagagatccatataataggtattagaattaacaggaaaacaatgtttttcttcatctgcgtgttatttgttgggggtaaaaataatacaaaaagacgagaatatcttggctggaaatcccgactttttggatctattttttatttccattacaaatatcttgaataacagatggttacgctagaagcaagtcatccgcttatggcttgacaagtgaataactaacggcttgtcaagtgaataactaacgagtaggggtagccgtcagttaacggcttgggaagtgatcagttattcacttgagaagccttttcccagagaagatatacttactttgccgatgaagtatatcttctccgggcataggatatatacttcatccgcaaagtaagtatatatggataaaacaggcttttttatccaaccagccatcgttctatattccgggtctcagaggagaagttcacgccgatcttgaagacctcccgattgtctccggagaagggtagggcgtagcctttctcctcgatctgccgcagggcttcctcggcggttccgttgagcttgaactccatgatatagatgtattggttggtttgcaatacgaggtctatacgcccgttcgaggtatggtattccacttgcgtgtacaggccgaccagcttgaagacgatgaagaggacgttctggtaatgcagctccgtgtctcgctccggcttttgcccggcgatcacctcgtagggtgtgtcggcaaagaagctttgcaggcggcggaagaatgcgtcgtaattgccgctttccacttcttgaacaaaacgtcctatctcgaagggtgtctttgcggcgcttatgctcgtgtagaaaggcaggaggtatttaacaaaaccttcctctacctccaagtttggaaaacctagtttataaatcccaaaacggggatcatagcccttgatggttaggtatccgctttggtagatgacgggtataggattattagaggcggaatcgatgctgttcagcacatcggcgtcggtttccgtgttggccatctcgtagaggtcgtaatgggtgtgcttgagcaactccaccagataagagggggtaccggtctcaaaccagtagtctccgaattccatcttggcgaaggtgttcaagagactgaaaggattgtacattcctgctgagttagcggtgaaatggtatccgtcgtatcgctgcttcagctttagacaggtagcctcataggtcatggcttgcgcatcagccaataccctcaattcgttttccaaataagtatgtatctctttctcggtgatgccgcatatttctatgtaccggttatccattgatatatccattaggttgttgaggtcgctgaacacgctcaccttgccgaacttggtcacgccggtcaggaacgctaggcggatatatccgtccatgctcttcagaacgccgtaaaacgctttcagtatagagcggtaggcctcctgtaactccggattcccgatcgcctgtagcaaaggcttgtcatactcgtctaccagtatgaccactctccgtcctgttctctcataggcacggcgtatcacgccggtgaaacgatcggatggtgttatctctctctcgtctttcccccacaggtcttcccaaaggttcagataacgtcgtaatatactctctaatgccccagggtcagaatatctctccgcatttaaatccaaatgtaagatggggtatcttatccagtctttttccaatttctccatggccagtccctcgaacagctccttctttccttggaaataggcctccagcgtggacagcagcaagcttttcccgaagcgccgggggcggctgaggaagtaatactgtccggtagtaaccaattgatagaccaaggctgtcttgtcaatatagagatagccgtccttgcgaattttctcgaagttctgtatgccgattggataaattgtctggctcatggctttgtgtatttatgtgacttatatacaaaggtaattctttctcccaaaagggcaagtaacggcgcttttttctgtacggtacgatccgtggatggcgcgtgccgtgagcgttttgcctttccacagctatcgcgtgggctcaaccagccacttttctatattgcgggtctcggaagagaagttcacgccgatcttgaagacctcccgattgtctccggcgaagggtagggcgtagcctttctcctcgatttgccgcagggcctcctcggcggttccgttcagcttgaactccatgatatatacatagcgatcggtttgcaatacgaggtcgatacgcccgttcgaggtatggtactccacttgcgtgtacaggccgaccagcttgaaaacgatgaagaggacgttccggtaatgcagctccgtgtctcgttccggcttttgcccggcgatcacctcgtagggtgtgtcggcgaagaagctttggaggcggtggaagaaagcgtcgtaattgccagaccgtatctcccgaacgaactgtccgatctcgaagggggtcttagaggctctgacgctggtataaaagggtaacaagtatttgacgaaaccctcttccacctcccgattcggaaaacctaggcggtagatcccgaactcgggttcatagcccttgatggtcaggtatccgctttggtagatgacgggtatgggattgttcgaggcggagtcgatgctgttcagcacatcggcgtcggtctccgtgttggccatctcgtagaggtcgtaatgggtgtgcttgagcagctccacgaggtaggagggtgttccggtctcgaaccagtagtctccgaattccatcttagcgaaggtattcaataggctgaatggattgtatataccctcggacttggcggtgaaatggtatccgtcatagcgttgcttgagttttaggcaggtttcctcgtaggtcgtcatttgggtatcagccagttccttcacttcgtcttccagataggcatgtatctctttctctgtgatgccgcatatctcgacgtaccgattatccatcgacaggtccatgaggttgttgaggtcgctgaacacgcttatcttgccgaacttggtcacacctgtgagcagggcgaagcggatggccctatccatggtcttcaatacgccgtagaagggtttgagcatgttccggagccggttttgcatctcctcgtcgtgcaagttctgtagcaagggcttgtcgtactcgtctatcaggatcacggccctttgtccggttttgcggtaggcccggtcgatgattccggcgaaacggaggggcagggtcacttccgagggacgtgtcccatattcgtcttcgtaccgggacaggatgtcgtttaatatcttgtataagctatccggagagtcgtattgggagatattcaggtcaaaatggaggatcgggtattctttccagtccttttccagtttctccatggccagtccctcgaacagctcctttttcccttggaaataggcctccagcgtggacagcaacaggcttttcccgaagcgtcgggggcggctgaggaagtaatactgtccggtagtaaccaattgatagaccaaggctgtcttgtcaatatagagatagccgtccttgcgaattttctcgaagttctgtatgccgatgggataaattgtctggttcatatcgtcctatattttatgcgacttataagcaaagttacataaaatataggagaggaaccgtatctttagaagtaaattttcaacaataatatcttactatgaagttgatttacaattcgctgataataagatagataaatgtgcttgtcggatttccgtaaaaacacgtacatgttttcacggattcacgtacgtgtttttgggaattcacgtacgtgttttccgaaaaacatgtacgaataaaaaacaagtctggaaaaatagacaataagtaagaagttttttactccttatacttagccaccataatcacggggttggattcctcattcaatcccgctgcgatctcattcaatcggcctttcagcttacctttctcgtaggcttccaccaactcattggcttctagtttctttatgaaagcgatcccatcgttattgatgatctttagtattccgtgttcgtaccacatattaacgggtgtctgatctacgaaatcgttattatatacgacacactcaaagatagcgtcctcttgtttatcatataccaagtcggttctggggaatccggtttctttctcaaaatcccattgtttctttgttgtttgcatgaaataataccggtcggtaagaatacttggataaagaaatacttccggggccatagagcggataggtggagtccttacgataaagggtttgatagagtgatcttgcgaataactataaatcgtatctgtagatggctctactaaaacccaacttccattttgggaaattaattcggtattacgaggtcccgcggcccaacctcctttcgataaaaacggtgatatcttatgctcataagggagttcgatttccttgacaatgctcccgtcttgtttggacaggagccaaaatgcgctttttctcagatttatataattgccaatctcatcgtagcagattaagttgtcttgatcgaaattgtatgtcttcccgctattgaaattaaaatctttatcgtactttaaagttcgcttaaagtttccggacaggtcgtatacgataaactggctcgagtagtagttgttgataaacagctcacctttctcctcatcgagggcaatagacccgatattcgtgtattcttggctaccttggccgctgcggttgatttttctctggccttttccggtccggtcgaagataaatatatctccgtcttgtccgttcttgtttctaaggattatgagatttttgccgatggcttgcatgctggctgaggttatgaactcctcattcgtttctaatgggatgtattccacatccaaaaagtcttgaagaatcagttccttcttcggataatttgccgtgatatccacggttaaaaagtcgttagccggttgcttaccactttcgcatcccgttatcaggaacaggatcatcgcagagattgtgagtataagtttcatggtagtatgtttttaaaggtgttcttttggcaaacatatgcttttctcactgtcagaaaaatattttatacatctattttcgtgaatgtgttgtttaacattatctttgcaagtcaatgaacgtgaatatggaagatgattttgatataagggatgcccggatgccggaaaacgagcgagagtacgagaacgtgcttcggccgctttcgctccgtgacttcagcgggcaggcgaaggtggtggagaacctgaaggtgttcgtcatggctgcccgcatgcgtaaggaggcgctggatcatgtgcttttgcatggacctcccgggttgggaaagacgacgttgtcgaatattatagcgaacgagttgggggttggtttcaaggtcacgtcggggccggtgctggataagccgggagatctggccggggtattgacctcgctggagaagaacgacgtgctttttatcgatgagattcaccggctgagcccgatcgtggaggaatacctgtattccgctatggaggattaccggatcgatatcgtgatcgataaaggaccgagcgcccgctcgatacagatcgatttggctccgtttacattgattggcgctacgacccgtagcggcttgctgactagtccgctgcgtgcccgtttcggtatcaatatgcacttggagtattatgatatggagacgctgacgaagatcgtgctccgtagtgctaatattttgaatgtaaaatgtgagttgaacgccgctagggagatcgcttcccgtagccggggtacgcctcgtatcgccaacgctttattgcgccgtgtgcgtgatttcgctcaagtgaaggggaacggagatatcgataaggcgatcgcttgcttctctttggaggcgttgaatatagatcggtatggcttggatcagatcgataataagttgctgacgacgatcattgataaattccagggaggcccggtcggattaacgacgatcgccacggctttgggcgaggaccccggaacgctagaagaagtgtacgagcctttcttgatcaaagagggctttatcaaacgcacgccccgtggccgtgaggtcaccgatttagcttatacccatctgggacgtagccgggtgggggaacaaggttttttatttgattagacagatagatatggcaggaggaatgaagcggctcgctaaagagacagccgtttatggattgagtagtatagtggggcgtttcctgaattggatgttggtgccgatgtacacacgtgtgttggccggaacaggggattatgggatcgtgacgaatttatatggttggacagccctgttgctggtcttgcttacttatggcatggagacggggttcttccgtttcatcaataagaaagaggagcaagagccgatgcgggtgtatgcttccgtgctgtattgcttgctgggaagttcggcgctgtttagcgtagcggttttcgccttattgccatctattagcgccggcttgggatatggcgaccatccggagtatatcgggatgatggcgggtatcgtggcggtagacgctttttgttgcattccgttcgcttatcttcggtataaggggaaagcatggcgtttcgccgggattaagttgctgagtattttcttgaatattatcttgaatatattcttcttgatcacttgtccgtggttgcatacgcactatccggaggcgataagctggttctatcgtccggattatggggtaggctatgtattcgtggcgaacgtgtttacgacactgataaccttattgcttttgatcccggatatcttgccgggcatacgggcgagagtagacggaacggtattgaaacaaatcttgcgttattccttcccgatcctcattctaggtattgccggtatctttaaccagacggcagataagatcctgtttccattcttgtttgatgataaggagtatgcgaatgagcaattgggtatatacggcgcatgcttcaagatcgccgtggtgatggtgatgttcacgcaggctttccggtatgcctatgagccgtttattttcgctaaaaacaagagcgatgataataagaaagcctactcggaagcgatgaaatatttcatcatattcgccttgtttatcttcctcggggtaatgttctatatcgatatcttgaagtactttgtcgggccggcctattatcccggattacgggtggtgccgatcgtgatgttgggcgagttgttcttcggtatttatttcaacctctccttatggtataagctgatcgaccagacacgatggggcgcctatttctccacgatcggatgtgtggccacggtctctatcatcttgctgttcggtccctcgtacggttatatggcttgtgcgtgggcatcgttcttttgtaatttattgatgatgcttttatcctattttgtaggacaaaagaaattcccgatcgagtacgacttgaaatccgcgtttctttatttcggagtggcgacggtgttatacgtggcaggcatggcactgccgatacagtctgaatggctccggttgggataccgtacgatcttattaggcgtattcatcgcgtttatggttaaaagggatttacctttacgagaactcccgtacgtaggacgtttctttcgttaatcggtaggttcggacggtttggacggcgtggcgattggcatcgtgataacgaagcgtgagcctttcgtataagacggatctgtctttatcttaccgtttagccggttaacgatcaagcgacataggtaaagccctaggccagagccgggaatgaaatcattggtcttcgtgaaacgctcgaatatccattcctgtttgtcttgggggatgccgcaacccgtatctgttaccgacagggtcactaaattggctccgctatccagatggtatgaaagcgtaatgcttcctttctccgtgaatttatttgcgtttgccagcagatgtgagatgatcaagctgaaataagcgcggttggtcaagatcatatcattctccttatcgccttccaccacatagttgatctccggcttctcttgatatttctttacctgttgcatctcatgtaaacaaagctcatggattcgtgtgggaacaagaggaagggaatcattgccgctatcgagctgggcgatctcaaggagattgttcagcatggaagtcaagtggtaacagttttcatagataatacggctgaaagcctgtttctcgtccatggagatatcgtcgttggtgatgagttccgagaaaccgttgatcgcgtttaagggagtccgtatctcatgcgacatattccggatgaaggcggtcttcatctcctcgctctcttgtgccttctggttcgctatcaggacctgctcgttggatttctgtaatgcttgataaagagatctcatcttgcctaaccggaaaaagatatagaacacggcgcataaggctagaagcaatagggatatatataggtaattctccttcttgcttttctgcaattccaattccaatgatttcttttcgatcaccaacttgttcgcccctttctcgatctcgagattctccattttcttccggagttcttgcatacgcaaggtatctagcaataccgcatactctttggatgtctcataggcctccttgtacatccggaggctgtcgtaggcggcggcttttgcggatacataggcgattacatgctccttgtaaagcggtatttgtttggagaaattgatcaaggagtcgctgaactcaatgaatttcatgtagtccttgatgtttaggtaataattggcggaagtatagtatagctcgtattccggggtggtgctagccgcctccggataagccttcaataacttttggaactcatggaaataggaagtggccaaatccttcccgatagcctcggcgctgatggcgaggttggagtaggcgcttagcaagtggcgcttgttagtcgcgtaaggacgtttgctcatctccgggatattggagtatcctaagatcgtattgagatagcgggttgcgtatttccctctctcccaagggtcggcagcgtaggcgcatagcatgaaataggtgttaggcaagaaattgtatgcgtatcgtaggggcagtttttcagcctcggtcaagacgttgtcgaaatattctttcccttgcttgaagtcctccttaagcatgttctcctccatgacgctgttgctgacagccataccaagtacataattgcaggctattttctcatagggagacaatttgtcgggttcctccagcttgaataggcaattcatgaggactttccttcttggttcaccggatgtgtagaatatgacgcgcgtatcttggatcattttcatgaacgatacgaggctggttctggcttctccttttagctcctgctcggctttggcgatatagacatttgcgctatcggtttggtccgtgttgatataatgccggagaatctcggtcaatgccgcttccttatagtaattgtcattcgcttttaaggcttcctgatagagttgtttagcgtttactaatatgtcatcgtttcgtgagatatccatcaagttggcgaggatttccagccttgtgcgctcggaggtcgttttttgcaaggcgcttttaagcgagtctggtgtagtcgtttgagatgaaacgacaaaggacataaataataagcataaatgtattagatatcgtttcatacaaatagaatctcttgttgtgtttattgtattacaaatgcaaatatacgtaatctcaccataaaaaagctattaaatagttagaaaaacaaacaattgaaatatctttgcataaatatgggacaagattaataccgcatggaaaaaggattgctacataaacagattatggatttttttgtccgtaatttcgacgtcaggcaggacaaagaggatgaactggacacgatagaatctattaagaagggagtcgaatttaaggggacaaatttatgggtacttattttcgctacatttgtggcctctctcggattgaatacgaactctacggccgtgattatcggcgccatgctgatctcgccgttgatgggaccgatcatgggattcggcttgggattgggaatctccgatttcgagttgatcaagcgttcgttccgtaatttcgctaccgctactatttttagcgtgattacctccaccttatatttcttgatctcaccgatcagcgaggcgcaaagcgagttgcttgcccgtacgcaacctacggtatacgatgtattgatcgctttcttcggcggtctggccggaatcgtggcgagctcgacaaagagtaagggtaacgtgattccgggtgtagctatcgctacggctttgatgcctccgctttgtacggctggattcgggttggcgagtggcaatttgtattactttttcggtgctttttatctgtattttatcaatacggtttttatcagtttggctacgtttgttgtcgttcgtttgttgaaatatccgaagaaagttttcttggataaacaacgggaaaagatcgtgactcgttacgtgggtatcattgtttttttcacgatcgtgccgagccttttcttgagttataacttgatccggagtagttatttcaatgatcgggtacgtaacttcgtatcggaggagttgactttcccgaatacgcaaatcttgaataaggtcgttacggatacgagcgagaaaaaggaggtgaaagtagtcttgatcggccagacggtaccggatgagatgatcgctaacgcccgggctaaattgcctaagtatggattgaaagatgtgcatttagtcgtgcaacaaggcttcggacaagaggccacggatatcaatgagttgaaaagcctcttgatgcaggatttatataagaatagcgaggaggtgctacgtgcgcagaccatccagatagattcgttaaaacgacaggttgacaaatatcagagttataggcgtttgacatccgagttgatcccggagatgaaggttcttttcccctatgtagtcgaggcttcttgctcgaatacctatatcgtgaatacggagacggcgaagccggatacggttatgctggtttatctgaaaagtaagacgatcattaaagatgcggaacgtaagaagatcaaggaatggctgtcggctcgtgtggaaatgaaaaatattaaattactaatcgaataatttagactaatcagagtagaatgaagttgatgaaaagagtgtgggcggctttgttgcttttagccgcttccggccagttatatgccgatgagggcatgtgggtgttgaaggaattaaataagcagaatttggcgagaatggccgagttgggttttaccccatcctatgatcagttgtatagtgagacggatccttgcgtggcgaacgccgtggtaatcttcggtgggggatgtaccggtattacggtctctaacgagggattgatcttcacgaatcaccattgtggtttcggagccatccagcagttgagtagtgtggagcacgactatctgaaagatggttttgtctctcaaagtaaacaggaagaacttccggttccaggcttgacagtacgttacctgaaagagaccgtagacgtgagcgatcgtatcaacagccagatctccggtatcgaggatgagttccagcgtttgtcggcggctgattctatcggtcgtgtgatttgtgattccgtgggaaataatgagttcctagcggctgatgttgttcctttctatagcaataataaatatttcttggtggtgtacgatgtttatcgtgacgtgcgtatggttttcgctccgcctagctctatcggtaagttcggtggcgatacggataactggatgtggcctcggcataccggtgatttttccgtattccgtgtgtacgccaacgcggataataaaccggcggaatacaatgcggataataagccttataccccgagatatgtagcggaggtgtctatgcaaggctatcaagataaagattatgccatgacaatcggttttccgggaagcacggatcgttatttgtgctcttggggcgtgcaacagcgtatcgagaatagtaataagccccgtatcgaggtgcgtggcatcaagcagggcatctggaaagaggcgatgttggctagcgacgccgtacgtatcaaatatgcctctaagtatgcgggaagctccaattattggaagaactcgatcggtatgaataaaggattggcgaatctaaacgtgatcgaacgtaaacgtgcggaggagacggccttcgctgattgggtagcgaaagatcaggcccggggcgctaaatatggcgaggtcttgaatttgctggaaaaaggatatacctcgaccaataaatatagagaggctttgacctatttgaatgaggcgttttctagtggagcggagattattcgtttggcccgtatggtgcaatcggtggatattgaaggagctaccccggaagagattactgtctttttagaggatcgtatccaaccgttcttcaaggattacgagccgtctttggatcagaaggtactggccgcgatgatgaagatcgcgaaagaacgtgtatctccggagttcttgccggatatttatacgagcgttgataagaagtataaaggaaattatgagaaatatgcggcggatgtatttaagaagacttccttattgtcgtacgacaagatcgccgagatgttgagaaatccgaagcaatatgagaaattgagaaaagatccggcggcggaactgagcttgtccgtattggtgtctatcttccagttacagcagttgatgggtgatgcggagtatgatatcgctaagggagaacgtttgtatttcgcgggcttgaaggagatgtatccggagaaagccttgtcttccgacgctaatttcacgatgcgtttgagctatggttctatcggagggtatcgtccttatgatgccgcatggtacaattattactcaacggataaaggtatcctagagaaagaggacccgacgagcgatgagttctgggtacaaccggagatactggatctggttcgtagccgtgatttcggaccttacgcgaatgaaaaaggggaattgcagctgtgcttcctctcgaacaatgatatcacgggtggtaattccggtagcccggtattcgataagaacgcccgtttgattggacttgctttcgacggtaactgggaggcgatgagtggtgatatcgcttttgaaccggatttgcaacgttgcatcggcgtagatatccgctatgtccttttcatgatcgataaatggggtaaatgcccgaggttgattgaggagttgaaactggttcgatgagagaaaaaagagatgggcatccgtgatttccgcggatgcccattctaaggagcttataatgcccatcgtaaggtgctttgaatgcctattgtaagcgccttacgatgggcattgtactaaatgcctaatttagacttgattgctttcggtattgcgtccttatgcaccatgatgtaaatcgtcttggcacggacaaagctatctgacatgttgaggtaaccgccgaatgtattacgttcggttccccaagagttcttcgtgatataatatttcgtgccgttttgatccttggcgatgccggtaaggtgcatcaaatggtcatcggtcgtgacgaacgcctcgaagccttcttgacggacctgcggggtgacgtttacttccgggaaaggtttctcgaatttgtagacttcctccagacgttccttctcgtccattttctcgaagcgggcacggtcggtagtcgagtaatcttccaccttctttacctccgggttgatcgccacgccattcttgaaagagaagcctttctcgctcacgtcgccatcccagcataccgtgtaaccgttattcaacgcataatccgctacttccatcatttcattcaatggtaggttatacatttgcgcatgctcccagttatcgggaacctctacctcgaatttctggtaatacggatgatgcgtgaagcttgtcagctcgatataatcgtccatattcaaccctagggaggcggcgaatgtcttcggggtatattccttgccttgataggtgaatttctccggaagcttgcctaggtaggtatcgaataggttatcgattagtttgtaatattccgggctccgttttttcatatccacggcggtcgttgcgattgccttgatgtattttaccatctcggcatgattgtgccggtcggaatcgtagttgatacccgagtacacctcttcaggaacgatacctacttggttgaaagcgttcatgaaggtgtgggagagacttccttgaccgatattacctctaccttggcggacataattatcctgcaactggttcatgtatttctggcggacgataaacatctcggagagatcgtacgtcccttttcccatacggagtaattcggactccatgaaagaggtcgtggcgaaacaccagcaggttcccgtggatgcttgattcttgactggcgtggcgggtacctttactacatccgtaaattggtagccttgggcgaatgtgctcaaggaacctaacgctaaggcgcatgatagaatgaatgttctcattgtatatgaatttaagtttatattattattgtagagacggggcgtgcctcgtctttactatcggatgtggtgattagaagcctctttcgaattgggtccagaatgagtctcccatttctctccagcgtagcatcgtggctccggcgaaatcggcggtatatccggttaggtattcttttgcggcctcctcaccttgttgggtaagaatctctttgtaacggctctctacgaaaggaagttctgtctgccctttctccgtaaaatgggcgatagatgctttcatacgatctttagtcgctccccaacgtacggtggcgagtttgttggcacgacggaaagcccatacggcggcatcttcccggtaacggtgctgtccgcaaaccttgaagcaagccgggagatctttcgtcccacagaagatggggatgcgggggctttgtccgggattatcataggccatccaaaccacgccgcctaccgcgtcgggcagccagtcacgcaattggatcacggtagagtaggagcattgcggcacggctacaaggcggtagcgtttcacggcatccggtctgagtccgtttaacatgtttaccatatccgtagtcatccacggattcgctaccgggctgataatggtatctgtctcgttactatcttttttcttgacggcgactttcaggttcttcgtcatatcatattccgtcccctcatacgtctcggagagaagggccatcacgtcggtcacgtcaaccggtttttccggttttacgctgatcggaagttcctcggcatcataagaaagatgcaaggatggcgccagcttattcaaaatgaaaaactcgcggatgctgaaggatttcaattctcccgaatagttcccgccgccataggcctcccagaagcggaacggtttcttcccgtcccagaagcccatgcgcttggctacctcgaatacgttggcggaagccatgcaattctccttgtcgctcggatctaccttggagatacgggggatattggccgatacgcccacatgatcgtcggggatgcggatcgccgcccatacgccaccgatcttatccggaccctcgccgaagacctcgaaatgccatacctctttcggatccgctatcgtaaggcactcgccccagtcgccatatccgtatttctcgatcaactcgcccattaagcggatcgcgtcacgggcggtcgtgcaacgttgcaaggcgattcgctgaagttcctcgatcatgaacatacctttcttgttgacaagggctttccggccggtgatcgttgtctcgccgatacccaactgcttctcgttgaggcagggataggcggtgttgaggaattgatacgtagaccgcgcttcgggcagcgttcctttcgcgatcatcccccgggttccctcggcgtattcggtatgcatacgtccggtatagaccgtggttgtcgtatcgtgatcgtacgaggcggaaggtacgatatccatccaagtgcggtaattgctatcgcaggtgtggctagtcatcacggagccatctgccgaggcttttttgccgaccatgatactcgtacaactctccgggttcaagatcggctccggatactggatttgttgcgccaccgaaacagataggctggcgcaaagcataagaacataggtaaaaagtttcttcatatttcttgtgttatttagatgtttgtatcaattaaatttgtaggcagcttttcgtacgtcttttacggatttgaatggcttattgggttttagatgcttggcgaggaactggtagatgccgagtcgtatctcggaagcttgtttcgtgtcggtccggtcgaagctatgggcaccgggagcacggtcgaatattttgtagtcgaacttctttccttcggccttgagagcacgtatcatatgctctacttccactacgttcacgtcatcatcgctagtattggtatggatgagcaggggatcttgtagtttttccgcgtgccagaccggtgagcggcgtttgtattccgccatatcctcccggggagtcttcccgatatggccctcgtcggagaagattttccgataatcatcggtggaatatcccatgcgcatgatcacgtcgcttaccggtactccggcgaaaccgcatttatatttaccggggtaggtgaagaggttcatcagtgtgatcattcccccgtggctccatcccatgatgccgatacgattggcatctacgatatcgaaattctctaccatgtaattgcggctgacgtagacatcctcgttttctaatcctccgtaatcgatattatcgtaagtagccttgccataccccgtgctaccccggtattcggcggagaccacgatgtattcttgggtgatcagttcacggacgatatgggcgtaatacgtattgaaatcagcgtgtacgccactgtgcgggagaacgatcaaaggatatttcttgtcgggatccacatttttagggatgaagatataagtccagaacttcagttcgtttccggcgctcatcccggtaggattcgtttctttccaacgggcgggaccgcaaaggtagactttgtcgatatgggcgatgtcgcccactttctcgtaccataggaggtcatctaccttctttacgacttggtcaaaatcatgttggtagttttgcgctatggcatagtttgttccgaatataaagaagaggcaaaagcaggaaagatgtttaagcagtgtcttcatgtgacttatctttgaatttgtgattgactgtgattttctggctgtaaatatacaataaaagaagcgtgatccgtaataaacgaaccacgcttctttgataaattatgtataagttgtatgttacttacgtttcttcctgctacgaggagcgtcatcgtagaatttacgcttcggcttgtcatcgctacggctggaacgtctgccgccacggtcgctttcccggcggctgtctctgcctcctctaccgctatcccgtcggtctctgaaaccgtttccgctacggctacctccacggctaccacgactgcctttaccaccttcgcctttcgcttgcgccggttctacggagatacgtcgtccgtctacctcgaagccgttcatcgagtccatgacacggttggcttctccctcttctacctcgaagaatgagaaattatcacgtaagtcgatacgaccgatacgaaccttacccggtacacacttattaaccaactctataagttgaggaggtgtaagctcgtctgtctttccaaagttgataaagaaacgggtgtagccttcttccgcttcgcctctaccaccacgtttgcctctttctcttggggcgctctcgtctacaacctcgatatcatcgttatctttataatagtcgatcatccggttgaactccaaggatacgacacgcttgatgatatcttccttatccagccattccaatttacggtagatagaaggcatcaaactagcgatttcctcctcgttcactttcactttctcgatctggtccaccaagttgaacaattgcttctcacagatttgctcaccggtaggcatcttgcctttatcgaatttcttgttaatgattcgttcgatctcgcggatcttgcctttttcccttacgtggcagatagagatagcgatacccgtttttcccgcacggcccgtacgtccgcggcggtgggtataagattctacctcatccggcagaccgtaattgattacatgggttaagtcatccacgtccaaaccacgtgcggctacgtccgtagcgaccaataactggatattcttgatacggaacttctgcatcacgtaatcacgttgcgcttggctcagctcgccgtgcaaggagtcggcgttatagccgtcttgaatcaatttatcggcgatctcctgtgtctccttacgggtacggcagaagatgataccgtagatgttcgggtaataatcggctagacgtttcaacgcgagatatttatcctgcgcacgaaccatgtaatagatatcgcggatattcttgtttccctcgttcttcctgccaatgacgatctctttcgggtccttcatgtatttcttggtgatagaggcaatctctttcggcatggtagcggagaagagcagcatattgcggttttccggtatagccgccaagatctcgttgatactgtcggtgaaacccatgttcaacatctcgtccgcctcatcaagaatgacgttctttacgttgcttaagtcaaccgtcttgcggttcatcaagtcgatcaaacgtcccggggtagccactaccacgtgtacgcctctcttcagtgtcttgatctggctctctatactggaacctccgtatacagggagaaccttcaggttatcgatgtatttagaataatcgttcaaatcgtccgctatctgtaggcaaagctcgcgtgtcggacaaagaataagcgcttgaggctgatattgagagacattgatcttttgcaggatcggcaggccgtaagcggctgtcttgccggttcctgtttgtgccaatgcgattacgtcgttatcttctcccagtaagaaaggaatcacttcttcctgtacgggcatgggcgattcgtagcccatctcttggattgcctttaatatcggtgcggcaactcctaattcttcaaatgttttcaaaatgcgattgtgtatatatgataatattcagtggccgcaaaggtacgtaaataattcggattcatatcaataaagtaatatatcttttagcctttcacgtttcttatcagtaagacgtaatcctttcgacaaatatttctcggtggaaccgtactctttcttgattttatggaaagctaggtccatgagcccctcgttggccgtaaggaataccgtaatgctttcttgggcgtctgtggagagatgtttcacgatatcagctaaatgactcgtatcgatatattgattggaagtcaagtagtcctccatgatggcatcccggggaatatccaaggcggcgagtaacatggcggtgagaaacccggtacgatcctttccgtaggaacaactgatgagaatggggtaattatcctcgttctggaactgttccagtaccttggcgaactgatcggtattatctgtcacgaattgcaggtactcgtcttccatatataccccggcgtctcctttccgcattcgtccctcgataacacgttgggggcatcggcgatcttgccgaccgagatggggatttgcaggatatttgctttcgtatatttgataggggcggtgagggtttcttggttcgtacggaggtcgatgatggtcttgatccctagattatccaatcggatggagtcccattcgctcaagctgcttaactcgccggagcgaaataccttgccccatttcaccgtcttcccgtttgtagaggtataaccgcctagatcccggaaattctgtacgctatccataaccgccgagcgtgccccgatgatccgtgggtatttatcattaaaagaaaggcggaaatacttacgtgatatattatcgttcgtgatgtaagtagctacgccatccttgatgttggcgtaaatgatcggggactcgttggtgaaaagatccgggttgtcggacacggtcatcttgacaatcccctccattaccggatcggtttcccattttatcacgtaatttccgatgtcatcacgtaggcaaatagctcgtatgtcgggtgcgttagaggaacaacccactaacaggatcacactggcgaatagagagagaatctttcctaacattgtcttctatgataataagctttccttacaaagatagtaaaacaagtttttcccgcttcttcattaatgatatttaagactgactaacatacttcgccgcgaactccttggatatataattatcatagctttggcaaacctcggaggcgaggtccattccgcagcggatgatttttctccaagtatcctgatccagagagggaaggtcggcatggcgtacgtcatactttagaagtccgtagataatacccgcgttaaaattgtcgccggcgccgatggtactaagcggctggatttgcggggaatcgaaatgtcgtgtgaaattacgggtgtggagattgactccgtttgccccgtgagttgttaagaaacgatcacaataaaactgaatatgctctttgtaaacctcctgtgcgtcgctcttgccataaaggttctggaagtcctcgtccgagccccggacgatgtcggcgaattccagattttccagtacggtaggcatgaggcggatcgcctcatgagcgtgtgccttgcggaaattgggatcgtaatagatgatcgctttccgttcttgggcgtattgcagaaattctaccatacgagtccgcaagaccgggttcagggaataataagagccaaacacgaaaatatcgtctttctcgatcttaggcaggggcacctccagccgttgcgccgggtaatccttgtagaagatataattagcgttcttatcgtcgtccagaaaagcgagtgatataggacttttcccatcggggaaacggtctacgaactcggtcgtgatgtggttatcttccatgaaatcccgaatcatgtcgccaacccggtcgttgcccagctcgctgataaaggatacggggacattcaatcgacctaatgatatcaatccgttgaagacggagccaccgggaacggccttctgtggttggtcgttcctgaaaatgatatcgaggatggtttctcctataccaaagacttttctcatgactatatactggtttgttattcgttcttgcttagctcacggctcttggagcctaagtagcccccgtgatggcgcttggcgtaatccttgttggtgaaatggatacgcttcatggttccgaccacgaggatatcgcctattaccgtcatgacggtcgtggaggtagtcggcgtaaggcctaacgggcaaacttccttgggagcgccggtcaacaggcatacgttcgcctcggcggctagaggactatccgggttactggtgataacgataaatttcatgtctggcaccaaacccctcgtgagatctaccaattccaccagttcacgtgtctttcctgagttggagatcaataacatgatatcgttcttgcatacgattcccagatctccgtgttgtgcctcgctgggatgtaagaaaaaagcaggtgtaccggtcgagctaaaggtggtagcgatattcaaggcgatttgcccggctttacccattccactcatgatcagttttccacctaggtcgtgtacatgtttcactataagcgataccgcttcctcatatccgggtgtaacgggtatgttgcgaaccgcttccgcttcctgctccaataaagaggtgatattttcgtttaccatattgttgattgattgttttacggcattcctgcctgaataacgatcgcgaaagtatttatatttactgatattggcatcatctatttcagacaatttatctttttaagacgtttgcgaattcggacttcggcttccatttcgggtatccggtatcttgtgccagtttataaccgaggtcgaagaataattgtacttcttgtaacagaccactgtaatcatccgtgtcgggatgggtctggtcggtcggtttgtggtaagtttccgcccaataatgtgcgatatgctctttggcccactccttaccctgtttgcggttgtcgttccaacctttggcgaacatggccgggatgcctttttgtacgaaagggaaatggtcggagcgatagaacatcccgttataagcgtcggggtcgggcatgatgtaacggttgtatttcttcgctagctcggctagggtatcatccagctcggagttgccgtatccggtgatcgtgacatcgttgttctcgccccatagcgggaagacatccagattgattacggcggctatcttatcaatcgggaacaacgggtgctccacatagtatttcgtaccgaggaatccggtctcctcgcaagtaggggagaggaagacgatattccggcggggtttctctttcaaggcattgaaacaacgtgccatctcgagcatccatgcgatggctacggcgttatcggtagcgccgttgatgatactgtcgccgttgatcggtgctccatagcctagatggtcccaatggcctagataaataacactctcatccgtgttcccgctaccgggaatataaccgattacgttggggctttgctggcggtcgaaggtgttcctcatcgagacggttaccgtagatttcaaggagatgggcttgaagtctggcgatttagattgctcgattagttggtcaatgtcgtagccattatcggccagcaattgcttggcggcattgaattggatccagccgtttagcgggcaatgataggcatcgctatcgctgtccacatacatcttagattgggcggaagctcgtacgaccgaccaaggatagcccgctccccggtcttcatggatgatcaaaactccttttaatccctgtcgggcgccctcctcgaatttatacatccaacgaccgtaataggtcatgatatcaccgttaaaataatccgtgttgtcgcttccgagtcccgggtcatttacgataacgaccgctactttatcctgcgggttctcgattccctcgaaatcatttttcccatactcgggggctacgatcccatagccggcgaataccagttctgcgttgtctatatcgatctccggctcgatccgtgcggagaaagcggtgtaaccttccaaccaatctaaggggattttccctttcggggtctttaggaccatcgggtccgggcatcgtgtgcgtgaggatatgatattaacctgttggaaataagaatcgccgttgatgggtttcagcccaacctctttcatttggtgagcgatatagttcaccgcacggtcggccccttccgagaatggtttacggccttggcaggagtcatgcgagatggcctcggtgtatcgctttaaatgttccgtggtcgctacgcttttcgctttctctatatcattacttcctcctccacaagcggtaaaaaccaaggaagtgattgttagtaaacaggttattattttcatgtttctcatagaattacaatgttttttcaatcagccattcacctaagttgcgagtggctgcgtcgaaagcgacccccactttgactacttcccgttcgtcggccgtataaggaatcggatagcctcgatcgtcgatttgccgaatcgcctcttccgccgtacctctcagcttaaactcgaatacgtagatgtagcgaggagtttttacaatggcatcggcacgtccttgggccgaacgtacctcggcctcggtgaattgccctagtagcttgaatacgatgtagaaaaccacttggtaatgacgctcggtccggtcattcagctcgtagggtatgtcggcgaagaaagcctttaggcgggtgaggaaagcctcggtgtttccgctttccagctcttgaatgaactttccgatataaaagggagtctcggtttccggtaaatgcgcatacatggaggcaacaaaattcaaaaatccatatttaacttcctcattcgggtatcctaacgtatataaccgaaaacgttcatcgtagcttttgattgtcaaatatccgctttgataaatcatgggcacgggattattgatgttcgcccgatcgtccgaaagggatacctcggatacctctatcccgtccagctcccgtatatcgtaattcgttttccgtaacatctccgccaagaatgtcggggtaccggaagcaaaccaatagtcgtaaaagacctgtttactcaacacgttcaatacgctaaacgggttataaagggcgataccgctgcggaaatcaaaatggtagccgtcgtatcggcgtgtaattttctcgatggtatcttcgtatgaaagcttattcgcctcggccaaggcataaagctccggctggaaagtcgcctcgatctcgggcaatgtcatgccacaaagggccgcgtattgcggggctaggctgatgtcgttcaaatgatttaggttgctgaaaataccgacttgcgcgaacttggtgacaccggttatgaatacgaagcgcagccaaggatcggcatctttgaggaccgtatagaaagcggtcaataattcccggaactcgttctgtagctcttcgttgtgcaggttcctaagtaatggcttatcgtactcgtcgatcagtacgaccaccttccttccggttatctccgccgcccttcgtatgatggtcatgaaccgtccggaataggtgataccctctcctccggtatcatatattttttcccattccctcaactggcgttccagcatattctccaatgccttgcggctatcgtacaactcggcgttgaggctgaaatgaagtaccggatgctctttccactcggtctctagtttctctatggctaatccccggaacaattctttcttcccctcgaaatatgccttgaatgtcgatagcagcaagcttttcccgaatcgccgggggcggctcaggaaataagggacaccttggtatgccatttgataaatgaactcggtcttgtcaacatacaaatagttctctgtacgtagtttgtcaaaactctgtatgcctatcggtaattttcggacgatatttcccatagccttatctgtttaatttacacaaatgtaggtattttttccaaggaggcaaatagatcgaaaaaaacacgtacgtctttttccggaaacacgtacatgttttttgaaaaagacgtacatgtttttccggaaagtctttcgtacctttgcgggctgatacaaacaagaaggaaaatggattatatcgctcatacattgccgaatggacttcgcatggtacatctcccggttaattccccggtctcttactgcggtttcgccgtgaacgccggtacacgggatgagaacgaggatgaatttggcttggcgcatttcgttgaacacatgatcttcaaaggtacggagaaacggaaagcgtggcatatcctgaatcgtatggagaacgtaggaggggagttgaatgcctatactacgaaggaagagacctttgtttattccatttttatggaggaggattttggccgggcgtttgagctattgaccgatctggttttccattcccaattccccaaacaggagatcgagaaggaggtagatgtcatcttggatgagatcaattcgtatgaggatagtccttcggaacttatattcgacgagtttgagaacttgctttataagggtcatgccctcgggcataatatcttaggggatgagggatctcttcttcgctttgactccgagtccggtcgttctttcatgcgtcgtttctacgccccggagaatatggtgttcttctcgatgggacgaaaagacttcaagaatatcttgaaatcagcggaatccgctttaagcgatatctctttcccgatggctgaacggatccggaaagctccggaccccatcgaggcttgcgtacgccagatccataaagatacccatcaagcccatgtactgatcggtggccgggctttcagtatgcacgacaaaaaacgtatccctttgttcttgttgaacaatatcttaggtggtccgggcatgaataaccgcttgaatgtctccttgcgggaaaagcatggcttggtctataacgtagaatccaatataacctcttataccgataccggactagccagtatctatttcgggacagacccgaagaaccgtgagaaagcgatgcgtttggtgcataaggaattggcccgtttacgtgacgtaaagctgtccgccactcaattagccgccgccaagaagcaggtaatcggtcaactgggcgtgtcgggcgataaccgggagggtcttttccttggcttaggaaaaagctacctccattacaaccgttacgacaccctccctgaagtattcgcccagatcgagaaaataaccgccgggcaaatcctagacgtggcgaatgaggtgttcgctccggaacggttgttttgcttgatttatgagtgaggctaattatggaacctatacccaacccccaacatcaagttattcggattatgaaatttgtgcagttggtatccgacatgcaggaataaatttcgtgtaaccgataccttgagggctaggatctggtataatcctttcaggtcgcccttgttgtaaaataaattatgtccgactcctatattgatcgagaagaatggcatggtgaattcgccacgggcagagaggccgataccgatttgctcatggaggggcgggcggtagaatcggggttcttcgccgacttggatgatctcgtcggaataaatatttgcgctttcgtcatattggccgtctagggagatacctgcttttaggaaccggttgaatttgtacatcgggttgaggttgaatccgaggatgccgaactgacctggaaaaatatgggcctcatcacctagcataacccccttagcacgggtcgcaccatataggatgacatcgtaactgacacgttgccaaaagctggagaggtataattgatttgccggtaaggaacgtgcggtacctatctcatgatggctttcctcgataggattgagcgtgtagacgagtccgatccggccaccaatcgtattcaatcccgcattcggaagatgagtatttccgtttgagtagtgcgttaaatccgccccgacaagcaggttgcaataacgggatagtttcgcgttgaggaaaaagcccagattgatataggcattgatcttagaaccgatgatcttattgcggtaattattgttatcatcatacggatgccaaccaaatgaggctccgaaattccactcataatcgaaggatagccgggaagaaattttggcgatgcgggagctttggaaaacatacgccgcccaaggattaccaacttcctgccggtttccaaaggtattataagagacgcctattccttggtaagtgtgcggataaagctggccctccttagagttaggattcagttggaatccgtatttcaaatggaatgaagccgccttacgtaaagtaagcccgtttccatagccgtcatctttgaggaatttactagtaggggcgacatacgagggacgtacgtcgaatcctattttgtggataatggatttatcatcatcttgagcttttaccgtacaggtccatatcatcatgaccgctatgtaaaagcttatcatcttgctttttatcatacttcaatacgtttgtctgatcaccaacactgcgctttgtctttcaactcgggtatcttgttcttatcgaatacagggcttttaatacccgctttcttttgggctacgtaatcctgtaataataggaacgcttgacggctcaacaatgagatcgcgatcaaattgcagatcgtcatcagtcccatggtcacgtccgctaggctccaagccaagtctaaactagccaacgcaccgaacatgaccattccaccgactaatatacgataaataaataagacacttctcttggacgtgataaaacgaatattcgcttctccgtaatagtaattaccgataatactactgaacgcgaataaaaggatcgctaaagcgacaaacgtactaccgatgctacccacctcgttactcaaagcttgttgcgtgagctggactccattgatggagccgtctaatggcgctccgctaaacaagatgatgaacgccgtgcaggtacagataatcagcgtgtcggtaaatacgcctaatgcttggatcaatccttgtttgactggatgggagacatgcgccgtagccgctacattcggtgccgatcccataccggcctcattactgaatagacctcgtttaatcccttgcatcaacgccgctccgacactaccgcctatcgcctgttcccaaccaaaagcgtttgacagaatggtttctataacagcgggtaggcgggtaatattaaacagtacgattcccaacgccaatgctatatatcctaatgccatgaccggtacgacaatactgcttactcttgcgatgcgctgaatacctccgaatatgacgattaacgtaagtaccgtaagaatcgctccgatccaagcatgatcgatgccaaaagcgccttcccaagctgcgcagatcgtattgctttgtacggaattaaaggcaaagccaaaggttatcgaaatcaatacggcaaataatacccccatccatcgtaaccccaaaccatgtagcatatagtaagcgggaccgccaatgaacgagtctttccctttttctttatataattgagctaacgtagactccacgaatgcgctggaagaaccaagtaaagcgatcagccacatccagaatacggatccgggtccgccgatcgctacggctgtcgctacaccggctaggtttccggtccctacacggctggctaaagatacggcgaaggcttggaaagaggagatatgcttttcccctttttctcctttcccggcagaatcgcctaataatcggatcatctcgccaatcatgcggaattgcacgaacctactttttatcgtaaaccatacggcgcatcccaataacatgataataaggatgtatgaccataatatatcgttgactccgttgatccaattattcaatagctccatgatttataatctgttgtttggttacaaagatacgtatctacgaagcaaattcatcgaaatattatttttttatcattttcttgtaacgttttccaaacggctgtcgtcttatagttagaaacaaatgataagcgggaaaggccaccctgctatattcggaaaaaatacgataaaaatgaaacggatgatgatttggatcatactgctaggcggtatggtacagggagcttttgctcagaacttggagataaagggaatggtgcgggacgctcgcaacaaagaaatcttggaatttgcaaatgtggtattgcaaacaatggactcttcttttgtagcgggtacgactacggatatgaaggggcattttttattaaataagattaaaaaagggagttatattctatctgtctctagtctaggctttaagacggagtatatttccttggaaggcttgtccaagaatatttctttgggagaaatatccttaaatgatgatgcggtatccttagacggggtgacggttagcgcctctgcccagacgagccatgccgataaaaaagtggtcttcccatcggatcgccagatgaaggcttcgggaaacggtatggatttgttgcagcagatgatgctaccgagagtgcaggtggatttgttgaacaacgagatcaaggccacgggaaatggggtagtccaagtgcgtatcaatggcgtgaaggtggaacaggatgagatcaaggccttgaatccctcggatatcatccgtatagaatatcatgataacccgggcttacgttacggcaatgccgatatcgtgctggattatattgttcgccggccggatacgggaggtagttttggtctggacatggcgcaaggtatcaattccatgtggggtgaacataatgcttggggaaagatcaatcataagaactcggaatggggcgcttcttatcggatcggtcctcgtgatttctatggaatgaaacggaataacgaggaagagttccatttagcgaatggaacgaccttgaaccgtgtggaaataggcgaaccttcgcgcgctcgtttgttcatgcataacctgaatgtgaactatagctatcaaaagccggataagtatatgtttaacgccacgttccgctaccggaataatcatcaaccgcattgggattatcaaggagtcttgatgaataaggcgaatccggaggataaagtggatatgatcgatctatcgggatcagcctatcaagctcctgcgctggatttatattaccaacgggatttgaagcataaccagaccttggtgtttaacgtggtagggacttataaccaaacgaaatcgacccgtatctatcaagagagtaaacatgaacaattgttgactgatgtaaataatgtggtggatggtgataaatactcgattatcggcgaggctatctatgagaagaaattaacgaatggtaatcggttgagcggcggtttacgccataaccaatctttctcggataacagttatatcaatgggcataactataagacgcatatggaacagatggagagttccgtatatgcggagttcaagggaaaggtgaaaaaactggattactcgttgggtgtgaccgtgaatcgctcgtcttatagtcaacggggtgaggatgcggattatgaacgttatacggtgagtccccggttgaccttgttttatgctttgcccggggagtcttccatccgtttgaaatcaacgatggggaatgtgactccttctttgggtgagttgagtgcgattgaccaagtgatcgattccttgcaaatacagcggggtaatcccaacctgaagtcttatatgagttattatacggaattgaattacgagtttcgcaaaggtctgttttacgtgaatgccttgggcgcttatgagtatcagccggacgctatcatggacgagaaatatctggaaggaaataagatcatccagacttgggataatcagaaaaactggcaacgggttgtcgcgtctgccaatttgcgggtcggtccgatcaaggacatcttgcaattttctgtcaatggtggtatgaaccattatatgagtaacggtaatacctacacgcatcgatatacgaactggtggtgcgaggcgaatgtttccgctacatggaagaaatggtcgctttggtatatggtaatgacaaattggaactggtttaagggcgagacgatgagtgggggtgagaatatccaaggaattcaactcggttatcggcataaggacttgatggttggcctgcgtgtcatcaatccgtttacggataattataagcaggagacggagaactggaaccaatacgcctctttccgccgttcaaattatatcaaggaaagttctcgcttattcatcgcgacgatctcctataatttctccttcggccgtaagttcagcgccggccagaagaaggtgaataacgctgataatgactccggtgtgatgagtaccggtaagtaagggaatattttatatctttgaggaaaaataaaatgagatatgaaagcgattaatccgaatgagatcaaagacaactttatcgagttgattggtaaggagtggatgctggtaagcgccggtgataaggagaagtttaatatgatgactgccagttggggcggcgtgggagtgttatggaaccgtccggtggtgtttgcctttattcgtccggagcgttatacccgtgagtttatcgatgctaggaatgaattcacgattactttcctaggaccggagcaccggaaagcccatagcatttgtggctctaaatccggacgggagattgataaagtggccgctacggggttgacgccgctctttacggaggccggcaacccggtattcgaggaagctcgccttacgttggaatgcaaagtggtctataagtccgagatcgaggaggccaagtttttagatcctaccgttttccctcgttggtatgatgagaagaacggtaatgcgcatatcgtttacattgccgagatcttgaatgcttgggagaaataatatcacccaagcagttctttcatcatttgctccgtatgcgtgaggaaatatttagtgagttggtaatgctcggtttcctcatacggggtgacatgcgctccggtatcatcgatggcgtaaatgtctgcgttcggataagccatcaggatcggggaatgcgtggagataatcagttggcaaccgttattcaccagttcgtggatacgcactaaaagggccagctgccgttgtggggagagtgcggcttccggttcgtctaatataaataatgtattgcggctggcataattcagaaaagcgcagagaaagctctcgccgtgcgattgctccaataaactcctgccaccgtaagctttataggcgtagatccggctgtacttacgtaattccagttgggcttgcctatccaattcggccgcatggttaaaaaaggattctgcccggaagaagaaatgcttttccggtttttgggtctcgatcagtttaatatgctcgggtaagacattggcgtaaatcttgtatgcctcggttccgtcatatagcatacccggttcttcctcatccctttcctcatatttactcatcatcgcttccagcagggtggattttcccgccccgttctccccgacaaggaaagtgaccggcttgcggaaaatgaatgattccgtgaaacgtactgccggagctttataaggatactttagctcctcgggatcgccggctaccaagtccgggtccagtaattttacttgcttcagatagatcatacagaatatgttttgttacaaacatagtgaaaatatcaatggaatgaaagataatatcgtaatcgttgttgttcgtgctccggaaactcttccaatagggataaatcctcccaaccttgtaatttcccttttttccggatcattttttcgatgatcctagcttgtttataactgacatatgggtgactggctagttttttagctgacagttggttgacaaatagatgactaataactgacgggtccacggaaaaccacgatttcatcgcttcataacgatcctcgtcaataccatatacttctcctagttgttctacggaataaaatcctcctaataagtccctgtatttaatgatccgcttggcaaaaacgctaccaattcccggaaccattttaagggcggtggtatcagccgagtttaattcgacaaccgttccttgcggccatttttctgctttgggataagagggaaaatggggctttgattcccttcggatgcgtttggatttccattcggaagggattttagtttcgttcgaatgggattctttttctttccgaatggaatttgaaggtgttttattcgaatagatccgtgaggaatcttgtttgattccggtgtttgccaatgggactgtttgaaattgggaacggtagaaatccgtcccgataattgcgatccatgccatcgctattaaggaaaggagtagggtaagagcctgcctttcccccttggagaaataaagtaaatcacgccatttcatagtcttatgttttgatttgtggaacttccaccgacaaaggtagaagttccgtttctattgacaaggaattctcggtattatttaccggtaatccatttcaagatccctaattcgttcaaaaatacgataccgatggcgattggggccacgtatttcataaagaatacgtaagcgccgaaaagacggaacttaagagtcccctcattggtcaactcggctttcaatacttttttatcgacacgtgtacctacgaaaatacaagtgagcatacctcccagcggtagcatgatcttggcggtcaagtaatccagcgcgtcgaaaaaggccaagcctccaatcgtgaatcctttcatcaccccgaatgagagtgaactgaaaatacctaagaaaaagactcctaaggaaacgatcaaagccgctttcttgcgtgtcatatggaactcctcaagaacgtaggccgtagctacctcatgtaaagagatcgtggaagtcagtgccgccatcgctagcaagatataaaaaatacaggaccacaagccactcagcggtaattgcccaaatacgttcggtaacgtgataaacacgagttccgcaccagcggaaggggtgatgccgaaactgaataccgccgggaatatcatgataccggccaatacggcgacaagcgtattaatgattgtcacctgccaagcggtggcctgcatattcgtatctttcccgaagtaagaggagtaagtgatcaggcagcccatacccaaactcaaagagaagaaagcctgtcctagtgcgcttaagaccactgaggaagtcaatttgctaaagtctggcttgaaaaggaaaagcaatccggcctcagcgttcggtaaggtcacggaacgtacgcacatgatcagcaagatcaagaataaaagcggcatcatgatcttagaggcccgttcgatacctttttctacacccgagacaatcacgaagtgagttaacccgataaaagcgcccatccaaaagatcggacggaagacattggaggcgaaatcctgaaaatcggccgtatagtctatatccggctgtccatacaaacggccacttagcgtttgccaaacatattcaagcgtccaaccggagacaaccgagtaataacttaatatcaaaaatgcggccaagatcccgttgtacccgatccagcaccattttgttccgggagccatcttcttgaaagaacccaccgtattactacgggaataccggccaatgaaaaactcggttaccatcaccggaatgcccaagaatatcatgaaaagtatgtagaccagtaggaaggccgcacctccgttcgctcccagcatatacgggaagcgccatacgcttcccaatccgacggcgcatcctacggtagctagtactacgcccaatttactaccgaatgtgactcgattgtttgccatattatttattgttgcttttatgcttttaattgttacctattttcttattttcgggagcaaaagtaataatttgaattaatttgttcgtgtaaagtataaataatttagtgaaaggagtatgaaacgaggacgtaagaaaaagttagcaatctcattgatggattatatgggaaaacgaagagacatgaaacggcagttaaagaaagaagggacagctgagttgtatgaggtggccgtaaggcattttttaagattcgtgaagaacccggggttctgtttggccgatttgaatcgtgcgttggtgatagatttcatcacgtatcttcagggaaaaggattagctactaatacggtaaatacgtatatcagtagtttgcgggcgctttataatatggcttgccaagagtcgttggttcctgcgtcatattatccgtttgagaatttgaaactccggcgtgcgatgacggcgaggcgtgcgattcccgcatctttgttccagcaaatcgctcagatcaaggtggtggatgacccgcaagtggaattatcgatagatctttccctattcagttttatggcttgcgggatgccttttgtggatatagcgtacttgacgaggcagaatatccgggggaatgagttggtatatcaccgtcataagacaggacgtatgatccggttggagataaccagtagtatgttgcaattgatccggaaatacgcggatcggcagcgagcgaccggatcgtcgtatttgttcccgattcttccgcccgggaatccggaccatttgaggtataagcgtagcttggctcggcataatgcccggctgaaacggattgggcaaactttacggttaccgaatccgtttacgtcgtatgttgttcgccatagctgggcatcagaagctttacgttgcgatatgccgatggccttgatcagccaggcgttggggcactcgtcggagaaaacgactcgtttttatctggaagaattggatatatcacgtttggctcatgcgaacatgaaggtgataggctctgtaaatcggattttagagaaaaggatggatggtttgtgaacttatttatggaataaggtttagcgtttcaaaaacgtcagcggagaataaacgttaaacaacattttattgtcgtttatatagtatatcaatagaccacacggaacgtttcagaaaaacatgtacatgttttcctgaaaagacgtacatgttttttggaaaacacgtacatgaaatccaataaatattatggtgtttctatacagctgccaatcaatggcttacatataggcctatccaaacgagcttattgtattatttgtttttgatattcaggaggaatttgtagagtatagaaattcctctttagttgagagagtgaatcaataaaggtgaatatggttcattttaaagacatagcttcccctaaattccttattgggctactgccacgtttaatttgggggctgaagtttatctcgcccgtcattggacacttgagttggaggcaggcttgaatccgttcagcggcaagaacgatgatgggagttatggccgttcactgaagcatttgcgtctgcacccggagttgaggtattggttttgcgagacgtttaacggtcatttcctcggcgtgcatactccgtacctattatataatgtagccgatatcaaatggctgggtacagagggcgagcgtcaccagggatggggcgcgggagccggtatcagttatggatactcgtggctgctgtctcgccattggaacttggaggccacggtgggcgtgggctatctgtacttgaagtcggacaagtatccctgcgcgaattgcggtcgcaagcaagaagggatcaagaagcattacttcgggcctacgcaggcggcgatcaatctgatttaccaattttaaatcgatggaggactgaaaaatgaagaatctacaaggatggatgatacttgggatcgcctgtttggccggttgtgtgggtactacgattcccgtacaggcgcagcagacggctaccgccatcgtcgtgaaggagcggttggtggagcatgtgggcgatcgcttgataattgatatgaaactagcgctggatgagttgtcgctatcggccaaccggagtttggtctgtacgccgctgatcgagcggggcgatagcgtaagggctttgcctcccgtgatcgtgaacgggcgtaaccgccagatccagtacgaccggtctgggcgcgatgcgacggcgaacggagagtttgtcttacgccgtcacaatgggaaggagcagacgttcgattaccatgcctctattcctttcgccaagtggatggagcgttcggaggtgtcgctggtagccgatttttgcggttgcggttgggaggcgttgagtaatgacaagtcgccgcttttcccgatccgaatcgcggagcctgtggtattgcggccgcttttggcctacgtcacgccggaggcggagcgtgtgaaagagcgtgtgaaggaaggaagcgccttcctcgacttcccggtaaaccgcacggagatatatcctgagtatcgcgacaatccctcggagctgcgcaagatccttgagaccgtgtcgtcagtgaaggaggatccttacgctaccatcacggaggtatatatcaagggtttcgcatcgccggaaggtacctataagcataacacttatttggccgagcatcgcgccaaggcgttgatcgaatatgtgaagggcctttaccactttgagcaggcccgtttcacggtggatttcgagccggaggactgggccggattggagaaacgggtggagaactcctcgcttgcggacaaggaggagttgctggccatcatccgtgcggacgagccgaaggattacgaccgccgcgaggcgaagctaaaggcgttgaacgggggggcctcgtatcgggtgctcttgcgcgatatttatccagccttgcgccattcggattacgcggtgcgctacacgatccgttcgtttacggtagaagaggcccgtgagttgatctattcggaccctaggcagttgagtctaaacgagatgttccgggtggcgcagacgatggaaccgggtagcgacgcttaccgcgaggtgttcgagattgccgtgcgtatgtatccggaggatccggtgtcgaatctgaacgccgcccttacggcgatcgacgcgggtcgcttggaatcggcccgccgttatttggcgaagacttccaattccgcggagcgtaccttggcggaggcggccatcgccatgctggagaaccgcttggacgaggcggaggccctgctgggtaagttgtcggacaatccttccatggcctcgcaggtggaggagaacttgaggcagatcgcagagaaacggcaagagtaaaaataggataagataacagacaaaaattttaatattatgaaaaagaaaaaatggtacgtagcgatggcaacggcacttttattggcggccggttgttccgatgatctcgacaacggaaaaaataacaccggggcggaagaggatggcgagaaggtctatatgacggtgaacgtctctacggtttcgcaaggaacgctaacgaaagcagatactactccttctaatcctaatcaggggggagccggttggggcgaggatggtaatggttctcttggtgagctttccggctctaaggagggtatggtatatgatgttaatatattcttggtgccaacagatgaagagtctttgggggatggcaatcagctagagttactaaatactgacaatggtagtagtatacagatcgcaggccaaggttattattcgaatctggaaggtattgatgcgagtttaggtggaactgagcctggtcatggtgacggaaaggttacgatgaaagtaaccatgaagaatcctctgacacaagataagagcaattatcaggtatttgccgttattaatgcgggaggaaggttgactggtattagtacgttggcagacttgcgcgatagagttgccgcaaacgatagggcattgtggactcctgctagtaatatggcggagtaccatcattttgtaatgtctacacataagatgataagtggtgctattccttctaacggcagttctatcgttgaactttctgctgcgaatatggatgagacatatccggctcggacaacggtgttcgtagaacgtttagccgctcgtattgatttggcatactcctcgaatttagatctgactaatataccgggaacttctcctgtaaagaataagggtacgttcacgttgaagaggtataaggtagtgaatcagtggaagggcgaaagttatctttttaagcaagtttctcctacggtacagtataactatggtgctaatgcggtattgccggcagatggtaccaacgatcctgttcgatatttaggtgatgagaaatggatatggaagaataatgacactggtgccggatcgtacaattatgtgttagatccgaagatccgggaaaagaaattgccggaaggggaaagttcttcttgggatcaatttaaagattcatatgttaattattttaatccgagcaattcaactgatttgaataacttggataagatggtgtctatgcctacttctggattaagctatacacaggaagtaagtggtgatagtcggacatattacccggttgtttataccaaggaaaatacgttggatctgaactcgcaggtacatggctatactactggtgtaatcttcgagtctgaatttactccgagtaacgactttaaggtgagttcctatgaaaatggggagatcaagtctgtgaatttgcctaatggtgataaaacgtttctttccgcggctcattataatagtaatggttctgtgtcacgtcttgtttataaagatgtgaagagcgttgccgcccgtgcgttcaatttggaaaacgacaagaaaaatttattgaaaggctttatggatggttgggacgatataactgcggatgtcaatgctgtgaagaaggcggttcaagatatgtcttctcaaaatggattagaaagcgcgtttaaggaatatttggatgggattttgactggtaaagcaactcttgatgaggatcttaaacagaaattgacttatgcggcttttaggagacaagcttcgcatcttccttctaatattacccctgtatctcaattcagctcagagcagatcggcaatttataccaatactataatgtttccctatacaaaagcggaagaagctatcacaagttttggatccgtcataacgataacggaaacgatggtctgatgggcgtgatggaattctgtatcgtacgcaataacgtgtaccagttgtatgtgaaaggtattcgtggcttgggcgatccgttaccttataccccgggtaaggatgatcccggtacgccggatgagagtgatgatgtcactatcgacgtgactatctacgtgaaggattgggtaaaacgtacgaacaaagacattatcctataactttacccttcgggggattcttacgatgggcattgtaagcactttatgctgcccatccaagcaaccttacgatgcccatcataaaaaccttataatgggcatcatggtttacctccatctccggtagtacgggcggaggattactgtgtatcttaataaaatgattatgaaccgtttatttcatacctgcaaacagttgattggcatagccgccttgtccgtggagctatacgcttgcgattggatacacgacgactcgctgccgctttgcgagttccgcctgtatttcaagtacgactataatatgaaattcgccgacgctttccagcatgaggtagacttcgttacgctcttcgtctgcgaccaagaagggaacttccttttccagcggcggatcgagaagagcgagctggacgagcggaactccatcgccttcgacatggagccgggtacctatcaggtagtcacttgggccgggctggacaagggcagttacgcatggaacgaccctgccgagacgtcgcaggctgtcgagagggcgcaaggcgtcaaggtacgtaccttgcgtgaggacgatacgacacaacccaacgaactgcacccgctttggcatagcctcgataccttcaccgtgacgcgcgacatgcccgaggccgacaccatctcactcgccaagaataccaacaagctgcgggtcgtgctgcaaaacgtgatgggtgaggacatggacgtgaacaacttctccttccggatcgtggccgacaacgggtatatggattacgacaattccctgctgcaagatcccaccatccactacctgccttattatacggagaacgtggagttgggagccgacccgacccccggcgctaccgtaggcgggcaatacgtggccgtggccgagatgaacaccatgcgcctgatggcgggccgtaactaccgcctcatcatccgtcatcacggatgggagaaggatgtgctgaacgtgaacctcaacgattacctccttctcaccaagatggaggggcaccgtatctccccgcaggagtatctggaccggcaggacgagtattctatcatcttcttccttacaccgaaggtatgccccgattgtccggataagcctacgcctccggatccttcgggacctgacaatcctgataatcctgacaatcctgataacccggataatcccgatggtcccgatccggaagaccctacgatcgtggggtacgcctgcttcaagatacaggtgaaggattgggtgattcgtatcaacgatggcatattgtaaacagagatttattaaatatcgctaatgatgagacgctataccatatataaccgattgacggcggtcgccgctggtctttgcctctgttggctttttatggcttgtggtgaagaccgggggggcgatctcccggatgacgacccgaaccattgtgttgtaactatcactttgcggacatcccgttcggtacgcccgccgcagacgaaggccggagggatgatgacgaaggcggatgaaactactgagacggatttctgggcaaaagatgaagaatacgagcgagacatcacgaactggctggtggtggcctatgatgagaatgcggattttgccggatatatatccggcaaagatggaacatggactccggatatcagtaatgaggattctcgtactacggtggagatgaaactaccctttggcacataccatttttatgcgttcgccaatttacaatcgttggaagacggtacatcgttgtatcaaaaaattaccgaagcccattccttggcggaactgtcggaggtgaagatattggactcgggaacgagtattgatacaaggaatgaggagaaaaaaggtaaattcggaggcgaggaagcgtctcgaaagcgtattcctatgagcagctacgcccaaaagcatacggtattgcccgctccggcagagaacaaattcgagattcccttgatccgcatgatcggcaaggtgcaagtggagataaccaataacttagataaatccataaccgtaaaccaattggacatcatgaacctccgcaagggaagcctgccgatctggctcttgccttggggaaatgagaattatttggagtttaaggataacaaggacttggaagagcctttggctccatcttttccgaaagatgcgaatcctcctgtagtaagtctagaggatctttatactgaatctatcaaacccggtgataatgaaaaagaaatacaagccaaacctgtggacggcgagaacggtagtaaacgagcttatattcgctacattcctgagaccaatgcagccgtcggagagaacggcggtggcatccacctcggtgtagagatcgaaggccgccctcgtacggagcacctcacgggcttcgacttcgtacgccgcaatgacctgctggtcatccctgtcttgataaccaacatcacgacgaatttggaagtagccgagcaacgcctccccatcggggtctacccgaccgccttggtctatggtgagaagacgggcgtgcaaatactgacgcctgttgagcataccttgcaagccgccggcgacttgtcgatccgtttcgagatatctagcatagaaggcgtgacaggagatttcacgatcaaaggtctcccgcaggagggaacggttacggaaacagcgaaaatcagttcgatccaagtaaaaagcgacgagaaacgtctcattacggccgtaaacggagaggattgtgacaagaaacagcgtttctaccttcccgaggcttcgatcaaggaaggaaagaaaggttccttcacgatccgcactcgggaactgggtggaaacgtggatgctacagtcatcctcacgctcattataaactattatgtgggtcaggagaagcaagagatgcaaatcccctacaccatcaagatcagaaactacaaataacaaccataatataacaacaataaactaaaaaaggaggacctgacggatgaaaccatcaatcaacctacgatataaatccttgttattaacttgcttgttaattttttccgctggtgtggctgtgccggcgtgggggcagacgtacacgatcaattataagaatggttcaccccaaaccggtattaccgaacgtgtggatacggtgtatgtggcagatggggaagagagggagttgtttattcctgagttgaggaataatgatggcttttataatgcgaactatcggtggtatgtacgttggtatcagcttaatgaaggtaatttaagttgcgaaaatataaaaggtaaggctataaatcctaagttagatggttcttttgtacagggtggtgccttacaggatcttataaatctctatccaagctcgttgagagacgcaggtacttctttatttttttataaagacttttataagatagaaggtacaactgctataaatagctctgtccctctcggagcctctacggttgaatattcagcggtgaatgtaaaagaagatcttgttgtttgtgatgtgagtttaaataacaattataaggtggatgggactacattcactgaacctactttgtccatacgttataaatttgtgattcgtccggcaagcgaaattgcgaatcgcataaaagattctaaagcggatgaaaccactccttttatggatgaaaccatatatgtcccgcaaaataatggaacgattaatatacaattgggtaggatcgctaataattatgcgtggtatgacggagatcaaatagtacagggagaaacttatcaatataagaaagacaatggcgaatggaaagatttgggtaatcgctggacacagattataaataatttgataacggttggaacacaacctgtaaaattagaaattcgggcggtgggtaaagataagacgaaagcgagtcctctgttggtgcgatataatcttatccctggtgatcatggtttcatgttacaggaaaagcaagaaaaagattctgacccaaggcgtaatccggataactatccggagttttatgaaagaataggatatataaattttgaccggaatgattcgatatctgtagacgatttgaactctgttaataatatggcaaagattggtttttctgataataaagaggataaaggtaaatggttggatccggagatcacgggatatgctccatttaattatcaaattcaaccaaataaggataatcggattcagaccttacaaaaccaatatggtttgtttcgaacagcggatgtggaaaaagtatcaacgaataatgaaaaggttgagggaaagacttatttttggtttgcaagtgcccaaagtaagcccaaagtggcaatctatgaccggacttattacaatacggggaaaaaatcattgggatatttcttttatgtggatgcggccaatttgccgggacgtttggtgaaaattccgttggatggtaatatctgtgcgcatacgggtattttagtgaacttttgggtgaatgatatgacgacatggaaagatactcaagccgaaggaaaacctctacctcctaatgtaaacatgaattttatcggattaaaagcagatggtacagaagttgttttacatcgttttacttcaggggatgcactgactgattatacctcgacttcggaagggcggccggctaataacaatattggtaaatggcagcaattaatgtactcattttccttgtcacaatcgcttgatgattatgtaggatattatctggaggtacaaaacaatacagctcattcatatggtgcggactacgccatcgatggtctgcgtatttatcgctccataccgcaaatcgacgtaaagcgagtagacgtgtgttcttctgccagcctgaccgttgccacggattacgaacttctgctcaagaatatgggttggagcattaatccggatgtattgtccgatctgaatatggggaatagcataacggaagattcaaagcatatatggaaataccgctatggtttgatgggtggagatccaaggaaaagaaatgagaatcttaataaaacgatcggaaatgtttatattggagctaccgataaaaaggaaaatggggatataaagaagcctgaagattggattacattaaatacggatttgaaggattatagtaatgagcgctataacaaccgaagcaaggtgtatcgtattatcgttccgactaaagaagggttgaagcatcaaggatttgaggatctgacaaatcatgaaactgcgatgcgacgacaaattgtcgtaaacctgcgtatgatcaatgatttcttatatgatgccgctgagcataaaatttggcaaaaagacatactagatcatgcccaaaaaacaaatggggataaattcccggaagaagagtatattgcgtacttgaaacaaaatttgagtgtactctgtggcaaatcggattcagagtgggactataagattccggaaccgaaagacctatctaaccagatagatagaataatggaggggaatgacaataatctgtacgaagaactgatacgggccgtttgttcggtaatgggtatttctcgtcctcgtgtgccttggtgggatgaaggaaatagcaataccatccatttgagtgccattgatgtggacaagactgagttgaaatataaaggggagcaaaatttcggaagtaaagagaatgccgcctccggtaggtatgatgtggtaatctttagtgcggccgcgacagttactagtgatgaaatcgtgaatttcccgaatgcccatgcgggagatagtttcaacgatccttgcttgctgactacccctttcaccgtactcccttccttcacgatcgtggcaaagaccaagacagatttgccggagggcatgatcgcttgcgagggacggatcagtcatattgaggaggcaaccatgtgggttgaaagatatgatgagaacaacaacttgatgaccggagagacagataagtttgtagataaatatgagggttattcatatacgttcgactggttcttgggagactcgctggaatttgctgcgttctatgatgaatatggattcgctttagaagatatattgaagtcttatagaaatacccttcccgatggcgagaaagcttcgtctttccccgcgaaaaatttgattgagtattatgaaaaattagacgcatataaagataagcctgggcttattgcgaaattgaagacattgcttttaggtgatgtagatacagagccgaaattggtgattggcgggaaattgggatatgcggagtttcgttgggtaaaaaaagtggtagcgattccttatctaccggagagtattcccgaggaggacagactttggcttttctgcgatagacctcaagaacgatcactggaagccgctcccgccccgaaactacttgttggtttcccggacgtgaagtatccggaaggaatggagcattatcccaatgttcccctgcgtattggcttgccgaatatcatggagaaaagcataaccgatattcctatccaaagcaatggcctaaagatgggtatgacagaatccaatcaattaggtctgcccgaaagcaatactacggatatcttcttgcggcaaggggctacttatacaaaggtgggtaatttgacaaagttgtctgcgaaagctaaaagtgaaaatgaggcaggtgaaactgactatggcggtggattattctccatgacttttgacgataaagcttatacaaattttgacgaaggccagatttatgccctctatatcccattcggtgaatataaggacgaagctttcgtaaaaggctcttgcgaaggatacgctaccttacttatcaagatcgtgccggaatatctgacttggaagggtacgaacaccggtgaggacgctgaggcatggtataatgacgcaaactggcatcagtctacgaaaggggaattgtacatagatccaaacggagaagataaaacagacgccaatggcaatgatgcagacttgaccgccgccttcgccccgcttcatttcacccgtatcacgatcccggaaaagcagatgctggaattggaaggcttggagacgaaagatcatttgttacagattcccgaagcgaactcatcaaaggctaccgagtatatccaatatgatatggcggtagacaaagacggagataatacgatcgtaaccccgtactatataaataaggtaaaggctatctatttcaaacccgaggcgcagttacgccgtcagcaattcctgacgtacgacactgcccatgtggaattcgagatgacacctgacgcgaaatattggatggcatcgcccctgcaaagcgtattcgccggcgatatgtacaccgtgaagaacacgggccgtcagaacacctatgctttcgccgatatcacctacagcacggctgacaacgaccgccaagccccagccttctaccagaaagcttgggacaaggcgatcacgatgtacgtgccgaagagcgaagcagatcaaatagtttcttttccggagaatggtttggatacaactcattacgaggtagtccaatccaactggagccgtgaatataacgatgtgaatgtgccctacgctttaggaaagggattctatgccagcgtagaaaagaagaatgcgaccggcttaggtgagaaagtattggtacgcctgccgaaagcggatgactcctacaaatatgaaccgtggaaaccggatacgaaaagcgctacattgagagccgccatgaccaaagccccgactttagcaaatcggatcaatgctggtaaactggcagataacaagtcgatcaaggtggtattgacagatgtgaatggaacggaagattggtggaatacggataatggaaccgtccgtgttattgctgatggtgacggcaagcacttcctgttgggtaatccttatatgtatccgttggatatcgttcgtttcttgaaagagaatgaggctatcttagagcaaaaatattggacattggatgtgaaggaggggcttgttgtcggtacacctgatgtggcatgggaaggtggaaatgttactgatgctacatccggagccgttatcgcctccatgcaagccttcttcgtagagctgaaagatgcggctcaaacgaaagcggaaggtacggcaaccggtaccgatctgaaggtggttcatttcgatccctccatgatgcaaggagagtcggagaaggtctcttcttccttacgtaccgctacggccaaaaaaccggtattgaggctgacagcagagcgggatgcatatcgtagcacggccttgttgacgcggcaggatgatgccgcgaatagctatgaggcagataaggatgccgtaatcttgctggatacggaactggaggagatcccgcaggtgtacactatcgccgggactcgtgccgtgggtgtgaacgtagtacgacggatcgaccaagtgccccttggcgtatatgccggcgagggtaagggggaggttacactgacgatagagggtatcggcgattgggcggagacgctttacctgtacgatgccgtgacccgtaaaagtacggagttgtcggacaatacgtataccttgcgtttggacggcagcagccatggacgttacttcctaagtgcgggctcgcctaccggtaatgagggggtggacaacgtagaatctatctctgtctattccgccgtatcgggtaggatagtggccagtgctagcgaggcgttgaagcggatacaggtgtttacgccgatgggtcgtttggtacgtaccttatatcccgcccgtccgacttatacgttcgatctcccggcaggcatctacattatccgcacggagatcgcccacgaccaaaagacggtgaaactacgggtattgtaaataaacccccttgttgttagttcgtttctaccactccatccttgatatggatcacccgatccgtgtttgtggccagctgttcgtcatgcgtcacgatgacgaacgtctggttcatctggtctcttaactcgaaaaagagggcgtgcaattcttccttgttcttggtatcgaggcttcccgaaggttcgtcggcgaggataaccgccgggttattgataagcgcacgggctaccgctacccgttgcttttctccgccggatagctcggcgggcttgtgtgccatacgatcggagagtttcaagaagtccagcatctctttcgcccgcttctcggctatggccgatttctccttggcgatcagggctgggatcatcacgttttccaaggccgtgaactccggcaataattgatggaactggaagacgaagccgatattccggttgcggaaagccgccaattccttatcgcccaatcgtcttgtctccgtgccattgataaccagtcgcccgctatccggtgcgtcgagcgtgccgatgatttgcaacaaggttgtcttacccgccccgctggggcctacgatagcgacaacctcgcccttgtttatcgtgaggtcgatgcctttcaatacttgtaaggcaccgaaacttttcgttattccttcggtttgtatcatatcaagtttcttaggacgtgcgaggcaaggaaacaaccgaacgttgccggcatataagagaccgttcccgtggtcgtacgtttacatgtttcgttttcaacttcgatcacggcgtccggatcggcgaactcggtggaaaatacgacgggaatccccttgcttacgcctagaggacgcaaccgtttccgcaccgctttcgcgagggcgcaattgattgtcttggagatatccgctatccgtaccaaggatgggtctaccttagcgcccgcccccatggaggacacgatggggatcttatggatatatgcttggtacatcaggtataccttgggacttagggaatcgatggcatctaccacgaaatcgagaggggccgataagagtacctcctccgtccgttcgtctcgcaggaattcattcaggacggttagttgcaactggggattgatatcaagcaaacgcttggccacgacctcggctttcggcatccctagggtggaatgaagggcgggcaattggcggttgatattactctcgtttaccgtatcggcgtctatgatcgtcatctttcctactccggcccgacaaatctgctcggcggcataagctcccacacctcctaggccaactaccaatacatggctacgggataagcgctccatatgctccgctccgaacaaaagttccgtccgtgtattccaattgtaactcatttatctatttttgagcacaaaagtaatcaattgttccggttcctccaatacttgcttttatccgaaagctttgtgtcttgttactgcacgggcgttgcagcgttactgtatgggcgttgcagtattactgcatcagccttgcagtaccaccgcaacccaggttgcagtggatgagttacgtcagatgggttgaatatgaaagactgatcctccgtcggaggccagcggaagggtgattttatccctgtaggtgatctcctcaacctcttttacgagtttgttcgagtctatattcgtatcttcagcatctttatagatcgttatcttatatttcttgtccttatccaagaacttgaggtctacatcgatactgcgtgcttggctgttattgatcgtaccgacaaaccaatcctctccctttttgcgggcgatcgttacgtattcattgacggaagcgttcggaacgactgtttggtcccaagtcgtaggcacggctttcaggaactcgaatcccggttgtccttcgtaagcctccggcgtatcgcaaatcatgccgagatagctctctaataccacgtacatcgctaacatatggcagcgggtactcattacgtaagggttacgttcttggttcttgaacttatcccttggcaaagagcggaaacctcctaaatgataatcagtcgctcccgctaataaacgggtaaaaggcatatggatgtcatgatctgcgtcggtatccttatcccatttgcaatgctcgtaattaagcgtaccctcgcgggtgaactcgttgggataggtacggctcaatccagacggcttgcaagctccgtggaattgcacgaatagatgatgcttagccgccttcgccaagaactcttcttggatgcggatcatctcctgatcgtctcgatccatgaaatcgatcatcatgccggcgattccccatttctcgaattgggcgaaagcctcgtctatctttgcgtacagaggtttccagttggtccataaatggatacgtacgccttgactcttggcgtaatcgcaaatctcctgcatattgaggctcggaacgactttcaagatgtccgctttaggacccggagaaccgaatccggctccatcctcgtcataccaagcttgctcggcgttcccgtagatcgagtgataatccaatccgttacgggctacgaaatcaatgtaatatttattcgtggggaaattgtttccgccaaggaaagtcgtatccggaacgacatttccgttccaccacgtaaaagtagtcttacccggcttaatccaagacgtatcctctatcttacaaggctcattgagattcgtaaggatattggacgctatcaaggaaccgatttgatcactgatcatcaagacccgccaaggagattgatggggtagggatgcctctaccttgatacgctcttgtcccagtttaggtgatagtttcccgagaagagtcccgttttctttccataggtacataccggcgtagtcacgaaccgccgcctcggtaatcgccatataaacatggttcgggaaagagaatagggcgggcatatccatcaatcgtttattatccatgtcggcataatctgtgaccgtatatttaccttcgtgggaactttggtagttggggaggaataaagtagttacgttcggattcccttgtaggttgaaggtggttccctcgtcatacatgatatacgaatcccatcctttttgcttcggaaactcatagcggaaggcgataccgtcatcgaaagccctcaagaccagattaatcttgcgaaaaggctgaacggtttcctctagcgggatgattacctctttggaaaggctatgtatatgtttcgccttaccaacgatcaattcgtaggtctcttccttcgtactgaacacgggtttgttgatctttacattttccccgaacgccccattatcgaaagtcaacgttagcggagagtcttggatcagggtttgtttattaaacgctacgctgtataccgggctattcttatccaaaaccaaggagaacttgatctttccgtttggagaagacaatcgcacgcttttatttgcgtataaagagtgagcgcaaagtataaaaaatgccagaatgaggtagattgattcttttttcatggatgataattttataggccaaagatatacatatttattttgtacggtttaactgcttcaacaattctttaaggctgacggtctcattcttgaccaatggttttgcccaataggaaatactcaagatatagcccagcgtgataaataggaaaaacatggaatagcgcaacccgatcagatctccaagtccaccaatgatgaacggaatcaatgccccaccgaaaatacccgtacacaagataccggaaaaagccccatgatgcttatccacggagttaagggctaaggcgaatatcaccgaaaacatgatcgagatcgagaagccgcaacaagcgaaagcgataatcgctacttgcgtaggaccgaagagcgctatcgataaattaaggatcgctatcatcgagaaaatacgtaacatcagctttgagtcgattaactttacgatcaccaatcccaacaagcagccgatggacatcaatccccagaaccaagcaaccgtagtagccccggctccttccgggctgaccccatgatacatattcaggaaaagactcatccaattcgccaatccttgctcggttcccacataagcgataatccccaagaaatagaatataacttgtttttgcttgagtaattctttataattctgtaccgttcccgccttctcatcttcctttaattctactttcgggaatttgacataagagataaccactaacatgatgacaaaaacaatcgtaaagataaaatagagcgagctccaaggtaagctctccggcgttatccctttgaggaaacggatgaagaagtcgttcgccggatcctcaccggttaatttccgcataagcccggccaagacgaacgggctcatgaaagaagcggccccgaatacgatctgggccaatacctgattaaaggcatattttttctctccgcccgcctcacgcatcaagggcaatataatcacctgtagcatcgccatgcccagaccgatagcgaaaagggaggtcaatacgatagggtaggtcgggaacatgacgaaaagccccgcacccaaaaacgtcagactgaaagcgaccaataaggaaatctttcccccgaaacgctcgatgatcattcctgccgggatggacatgatgccatatgccaagaaaaacgagaacggcaagaatgcggccaatgtcaggctcagcccaaaactatcgataatcatcggtagcatagggcctaatatattggtaacaaaagaaatgacaaaccaaatacacaagatgaggagtacgatccaattattcttattcatgatagatagattcaatgattaaacaccaatgccgccgccccgaggcatccggccttatttcctaatcgggcaagttcgatagtcgtgaagtacgaggtttccttcatcacgaatttccagacctgttcccgtatattattaatgtagaaatctccggattccgaaatgcctccgccgataatcaccttttgcggagcgaaaatgttgataaggctcgctacgcctagggacagattccggaaatgatcctccatagcgagtacggcctctttctcttgagctttatagcgctctactatatattttccatcgatacgggaaggtatctcccgtccgttcttctccaataattgccgatataaggcgatcaacgcacttacggaagcgtgtgcctctaggcaaccggacgctccgcaagtacattgattcccattcagaccatgaataattaagtgcccaagttcggtgccccggttccggtagccgccataaagccggccgttcaagaacaaggcgccccctatgccggtacccaccgtcaagaaaacgatatcggagaggcccttagccgccccatatatcacctcgcccaaccccataaggtttgcgtcgttgtcgatgaataccggtagattaaattccgctaacgcaagatccaattgttggttgtccagttcaggaagattattggcaaagagaaccacccccttatctactacggaaggtacacctatgccaattccgtaaatcccccagtcccgggaacgggcgtagtctgtcattttccgtacgatactttttatgatatcggataatgggcgtggattctcttttgattgtgtggtttccgacgattcgtaaagaatgtcgccattctggttcacaagagtatattttatgcttgttcctccaatgtctaatgcgatagcgtatttcatgataattgtaaaagcttaattagaactatgcgccgcttccctgtcgatcaggcaaatcacgttcgggtgcagccacaataaggaggccggcaactccgtcgagatcttctgttcaaggaaagcttgagtaatctcccttttctttatcccgttgataagaaggataatcaggcgtgactgaaagatattcgccatgcccaatgtcagtccgtatcccggtttttccgtatccccggcgatcatgggatgttgcaatgatttctgggacagatgagccacatggcaattcgtatgtaaggaaggagccggctcgttcaaggcgatatggccgttcatccctattcctaatatacaaatgtcgatagggcctttttgatccagtatctgttggatccgctcacattccgcctcagggttctccggatcgctttggaacgctatataccggtcttccgggatttgaagcggacctacgaaatagttccgtagatacgactcgcacgtacccgggtggtccatcgggattcctccccattcatcaagctttagtaccgtgaattgggagaataattccggttggcgaccggcttcctctaccagcaactcatacatccgggtaggagagcccccagtggcggcacaaagcgtaagtgccttgtgctgccctaactctgaggtaacaatctcttttgccttaaggcttaatgcctcataagattgacaaatctctattctcatacgattttagagctctttgattcggatattgcggaaacaaacaccataaccgtggtcttgcataccgatgtaacccggttgttttccgcattgtagcatcaagtcgtaagcttccgggcatttctccggactcgtgctgaacttgctgaacttactatgatccactaacgcgcgccataccggtgtaccgaactggaattccagcactttcacgtcgttcatgtaatggatcacgcgttggttatagacaacgattctcgtcttgttccagtttccgtacggttttacgggttgtggatccggcataatcatgtcatatacggcaccggcctgacggttaccatcgcaaccttcccatgcgtccggcatattctcgttgtcgagtaactgatattctgggctggagtaataaataggtgtaccctcaatttcttgcgcagtatagaagataccgctattaccggccttgtcgatcttccattcgatctcgaaaacgaaatttttgaacttcttgtcgtagatcaagtcgccgaagcccgtgtctgccttattgtcgctacctttataggtgatcgatccgtcttcaaccacccaaccttggggtacatcctgacggcaatagccgcgccatccgttcaaggttttcccgtcgaacatggtgatccactcgcctcccgtagggataccatcgctatcgagggcttgggtttgggcggtttgcgttccggcattgttcgtattgttattgttgccagaggtacatgatagagccgatgcgaataaggctacggccataatactgctataaatctttttcatctttgtatagttatttaagtaaattatctagttgtagagacggggtgtgccccgtctcatcccattgttgttcgcttttataacttgagatcttcccatccatcgcggtatttccgcttgatgaattggttcgcttgctcgaagttggtgatacgcatgttcgctccgtcccactggaaagttttgtttcttcccggatagataaagccctcgcgttctccgtagatcgagtcgttatgtttcacttgttcccggatattatagctgcgtaagatcaggttacccatcaatacggtctccgtcaacggaccggcgtaaccttcgaatggtgattctacgtccgccttgtcgtatcctgcgatacaagagtcgatccacgcccagtaatgaccgttcgtgccgccttcgatacgtttgtatttatgaggaatgttcacgtccttgtcgaacagcggtttcttgttcgccttctgtccctttggccagaatctcgggtcggaaccgccccagccgcaagaagccatacctttcgtacctacgaatacggttgcgccttctacgtccatcatatccaagtctcccatcgtgcaggtcatgtctgcatccggatcgatctcctcgaaacgctccggcatgataccaccgtccatccaatagagattcaggtcgcttccgtctttcttcttgaatttataacggatcgagctggctaccgggcaactctcaggataataagcctcctcgaagataccggagtagacattggtcgtgctgcaagaaacctcagtcggataacctaattgaagcaatttgaatggagggccgatgatgtggcaacccatatctccaagagcgcctgtaccgaaacgccaccaaccacgccagttgaacggaacaagattatcgatataatccacatactcggcggtacctacccataagtcccaatttaattccttgggaacctcaggcttctggctcggccaaggaataccttgcggccatacaggacggttggtccagcaatataccttctggatgtcacctaacagatctgcctcgaaccattcacgaagggtacgcataccgtcgcaagagttaccttggtcgcccatttgggtcacgaccttgtatttcttggcggcctcggtaaggatacgtgcctcgtaaatatcgtgcgcgatcggtttttgcagatatacgtgcttacccatccgcatagcgccgaaagcttggatcgcatggttatgatccggggtggagatacatacggcatcgaagttcttgccttccttgtcgtacatctcacggaagtcgttgaaatacttcgccttcgggtatttcttacgagcgtcggcagactgacggtcgtctacgtcgcacagacaggtgatcgctgcgtttttgtgcggcgtattcatcaagctacccaaatcggcggctcccataccgccacagcctattttcgcgatataaagcttatcgctgggagctacgtgtcctaatcccgctacggtaaaactgggcaggatcgtaagggcggcagcacctgtggctgccatcccaaggaattcccttctcgagattccagtcggacaggattgtttatttacctctttcataaatttgttcatattatgattaataattgaattggggtctaaagaattgatattaaaaacagactgatatgattagaatgccggatatcccgggttctgaaccaaattattattcttctgccaagccttgaacgggatcgggaagatcttacgatattccggagtctgtttcggcttcatatatctcggtttcagataagtcccgaagcggatcatatcttggcggcggacaaattcgaatgccaactcataaccacgctcgttatagatatcgtccaatgtcacgctcgtgtaattatgatcggaattgccgtaagccctttcccggatagcgtttaccagacgagtagcttcaccgagatccccgcccatacgaaccaaggcttccgctttcatcaggtatacatcggccagacggaagatagcgatatcgttctccatattggtattttgcatgcctttctcatatacccacttattgatacgtgcgccgtcttcttggtgaacctcgccccacggggttaagttaccatccgcatcggttttctcagttcccggtaccacatttaagtcgatcgtatggatcaagtcatgtcctagggtcgttttcaaaatctctcccgtgctagggtcgatcatcgggccaatcaagaacgaaccttcgtaacgaggatcttccgtatcaaatgtgcggacaaaatccggctgggcgttgataccattccacataccgccggtgaaacctaatacatcgggatccagataatgcaatgtccaaagatgaatggagttaccccaagcatcagatgccttgtagcagatcgggaaaataatctctcgtgatacctcgttatgaacctcgaaattggttttccaattcggctcgatgatatattcgagtttcatgatctcgtcgcactgctccactacacctttccagttcggctcgccgatccattcctcggcgttgaggtacatctttgccaataccatacgggcagccccttgcgtgaacttaccgtagctggcgtctgatacatcggagcgtaggttcgggatgatctcggttaattccttcaccacgtatttatacagatccgcacggctcgtgatggagggcaaggaggtatcctcaaaatctgtcactaatggagcgttaccgaaaatatctacgattacataataccagaaagcgcgtaatcctcttagctcagacaagtattgaagcttaagttcatcgctcatcgcctcgcttttctctataatattatatacggaattaactgtggttaaaccttccgtacaatatgtccagcaattctctacggagtaagagttcggtttccaactgtgcatacattgttccatgtattgtccgccgtcccaccagtcgccacctacacgtgtcggtgctatcaagatatcggctgtcatatcggccgctccccaaggaccgtcataagccagcatgttctttagggattggtatgccggagccatgatcgcattaatctgcttttctgttgtcccgaattcgtcggtaggaagcttgtcgtatacgttctcgtccaaatccatgcaagagacaagtgctaccggagcgagtacggcacatattatatttttgaataatcttttcatgatcgttactgtttgtgtattagaaattcaagtttaatccaacagagaatgtgcgtgccttcggataaaattcacgaggttctacacccggggtcaaaccgtctcctgaatccataggaacttcgggatcaagacctttatatttcgtgataacgaataggttttgcgccgtgaaataaacacggataccattcaatgctttgatcttataacctaaagtcaagttgtcgagacgcataaaagaacctttctctaagtaatagttggagaatcttggagtttcgcttaacgtataggtcaatggatcatccaatgcgtttgttcccggcaagaatccggattgagcgtatgccatgcgggtcgcgttcaatatatcattaccgatcgttccacgcaagaagaatgacaaatcaaaattcttgtagcggaaagtattggtgataccatatgtcagtttcggttgagcggatccgatgtagtcataatccgccggatcggaaatctcgccgtcaccgtctttatctaccatgatatatctgccgttctcatcgataccgttgcaaaccaagccatagaattgtccgatagggcgtccctcttccaatacgtgtgtaccgctggagcttccaccccggatgaatacgtcacctaataagatcttatccattgtaaatacgtcgttggatagacgagtcacttcattctcattatgagccaagtttaaggagatgttccaatcgaaatccttcgtgcggatagcgtctgcgttcaaactcaactcgatacccgtattacgcatatcgcccacgttagccatgatctcgctatataggtaaggaggggttggcaccggataggtataaagcatgtcagaggtctttttgttataccattcgatacgaccacctaggcggctatccaatacggagaaatcaagtccgatgttcaacatcgctgtctgttcccattttaagtctgggtttgcgttttggctgattttataagaaggtagccaagaaccggtatcataatatacaccatctgtgccgtaaagctcgagggttttgtaggggtccaatcctgtttgattaccagtgataccataaccgacacttaactttaagtcgttaagccagtttactttttccatgaatgactcttgggtgatattccaacccacggaaacggaagggaaggtaccccatttgttattcgttccaaatttagaagaaccatcccggcgtacggtagctgtcaacatatatttctcattgaagctataattggctcttgcgtataaagagatcaggcgactttgccatttttgagactctgcgtctcccggattcagattttgtcccgcggctaaattgttagcacctaataaatcagtgacgaaaccacgggtctgtacgtgagtctcctcataattctcttcttcccaagagtaaccgatcaaggcattgatcttatgcttattgaactcagctgaataattggcggtccattccatcaagtctttatcacgtagtctggaccaacgttcggccttaccgccatcgttgtaaccggcttgagactcgatactgttgtatttgctctcatcttccgtattccggcttttagctaaaagaactttagcctctaagccatcgataatcgtataaccgacatcagcggttccatagaaattattgatgcggttcttatgtgtattctctttctggttacgtaccgggtttccttggtcgtattcacgtgtgtcgaaccaagatccatcctctagcttaaccgggcgaacgggaatcatattgtaggcaagtaagaaattggtcgcattggtcggcgcgttatctgtaacggtagccacgccggtgatgcttactttcaaacgatcctccagagcacgttgggagaattggaaacgggcgttgtaacggttcatggagttatcgcgtgcgataccttcacgttgcatataagaaagggaacctctatagttatggtgtgaaccacctcctgataaagacacggcatgatcctgttggaaaccgattctcgtgatctcgtcgaaccaatccgtgttcgctcccatgtcaaaatccttaccgtccttacccggggtagaggaagtatagctacgccattggtccgctgttagcagattcggcttgttagccaaggtagatacaccgaacgctccattataagcgatggtcggtttgctggcgtaacctttcttagtcgtgataaggataacaccatccgctgaacgggaaccgtagatagcggctgaagaggcatctttcaagatagagatagattcgatgtcctgcggattaaccgtagacatgtccatgcccggcacgttatcgataacgattaacgggccttggtcgttttgcaaagtggatagacctcttaattgaatcgtcgagttgcccgttacgtcgccggaacctgtattgatcgttaaaccggccaccttaccttgcaacaaatccgctgcgttacgagtcagaccttggttgaaatcctcagcggtcacgttggtgatagaaccggtaatctcacgtttcgtctgcgtaccgtaacccactacgactacctcatccagtttttgagtgtcctctttcaagtttacattgatctcgtttttgccgcctaccggttgcaactgtgtcatgtaaccgatataggagaactcaagggtcgcgtttgaggatacttccataacgtatttaccatccagatctgtaatcgtgccgttggtcgtgcctttctcgactacgttagcaccgataatagcgtttccttccgggtctttaacgacaccggtgatgcgtttcttagtctgttgggcaacaatgtttttattaaatacattgatatttcgtccttcgatcgaatatttcaaactcgtgttgcgtagtgcttgcgataagatattttctatggacttatcggttgcgttcacgctcacttttacgttctttacgtcagaatccacatagaagaataagaaatcgctttgtttttctataatagcgaatagatcggttagcggggcttgatccgtcttcacggaaatcgttacagattgtgaataggaattagtcgctaccgcttggaacagtgtcaagaaaagtaaaataaaggacatttttaggaccgagagcattttttttaagtctttggacctaaaagacctataatacgaaacattttccatatttttgtactgataaaaggttgataatatgcgtctgccacaaaatttggtcgtggagtagcagaagcaggaattaattctttttaatggggccggctgtatttttgcagccggttttgtttttttgaaagataggatccgtgttatctcataggcattgcttgttttttaagatgtgttgatatttttattttattgaatatagtaagttccatctctttgtgaccatttgatcggcaaactacgagagatcacttgtaaaatctcctttaaagattgatcctcactgaatgttccggatacagtgacattcgggtccagcaatctcttgttttctatatggatcggaatctcgtatcttttctcaagctcattcagcaaggtacaaagcgcaatcgatttatactttagcaagccgtctttccatgccagattttcttttgcgttgacggattggatatcaatcttgttcgttgaacggatgaatgtaagttgctggtcgggagcgagtaagacttgttgtgtcgggctttcgaaacggatagacccttccagcaggacggccgtgatctgatccttccctttatcggcttttacactaaaggtcgtacctaatacccgtatggaggcatttcccatatcgacgatgaaaggtctttccggatttttcgccacctcgaaataggcttctccttccaaattaacctttcgctgatccgtaccgtatgcgtcagagtaggtaaagcgactattccggttcaaaatgatcttcgtaccatcatctagcgtaaaatgagatttatttttatcggttatataggtatagaattgctgaaccttagcttcccgggtatttaagtgtattgttgcgaaaaacagaacaagaaaggcgattgccgccgcaatgggagtagcgatgaaacggatcagcctcaatctcttttgcctgctttgatcgtcgatcttctttctcaaattatcgagggacacattaggcattaaggaatggctgaacgagacttccgcatcccaataactctttagcaaccgaaattcttttttgttcttttcgtctgcgttcagccattcgctcagcgaaagaaaatcttccgaggagctgttgccacttaatatccttgtgataatatgatctatgctattctccattttaagttgtttctatactaatagtcgcaaccaaatttgaaaacccttagtgggagcatggattttttacttatttttttcgtagctcatacacgagttctttgtattcggagattgcgttgaatgaggggcattgtttgatccattcatccggcgagatcgtcccgtctccgtttaagtcctccgagagatcccggtgcccacagacccatgagccgggaaagcagattaagagatgccggatcaaacgtaacaacgaggtcttttgagcctgtgtgcgggtatcccgtgactgtccggtgatgtccagtccaccctcgtagcaaatcccgatgctgtgtttgttgtgtcctctcgcatgagccggaatttgctctagcgggcgcaggttcaccacttctcccgatttacggatgtagaagttgtaaccggcacggaggaatccccgtgccttgtggtcactctccagttgctccgggctataatccgtattctcacgggttgccgagcaatgaatcatgatcaggtcaatttttctcatatctcgtccgggctttcgctatcagaacctgcgctctttttcgtaacctccagaggctcgaaattcacctcattgcgggtagtccgcagggccgagcccgggaaaaagataatacgtaccccctttatcttggtggcgtcgaagtcctcgggagtattcgttccttcggagttaatagacatacggaagttaccaaattctcccaattgcaccacgttgccggaggacagttccagatccatcgcccagtttaatgaatcgagcaccgctttcacgtccgccgacgaaagcgtggagcgagagcaaatcagtttacataatttgttgaggtccgaagtccccgacgttttagcgatcgcgtagttctttactgagtctttctctgcgccgttcaataccttacgctttactactttaaatttcactgccataattttaaattttaaaaggttaattactaatgacaatgcaaagatagaccctctgaaaaacgggaatcggcgagtgtcggtgagtgtcgggatatgtaagtagtagtcggtttacttgttattctggttttttattacgtaatttgcgttacgtgaattgcgaaacgcagataagatgctgaatatgaataatccttttttaatagttggttatcaaggtccagaatatttttgtgatcgggagaaagagacagaagtgattttatccgctcttcataatgggagaaatatcacgttggtaagccggataacctctcgcaatctacgctgaaggagattttcgactacttgcggcagtctggaagagaatgttatctggctattgacgagttccagtaaatcatggaatatcctgagaaaggggtggaaggcctattgcgttcttatattcaatttttgccgaatgttcattttatcttttcggggagtaaaaagcacttgatggaatatatattcttctcaatcaagcgccccttctatcaatccaccccaaaattatttttagacaagatcagcaaggaggtgtatttttcctttgcccattctttcttcgagaaggaagggaaggagcttccggaagaaatatttgataaggtgtacacatgggtagatgggcatacttggtatgtgcaatatcttttgaaccgtctcttcgctttaccggaaaaaacactttctccggagcttcttgattctctcatgatggagatcctacaggaagaagaatatacctaccagacttatttccaattgttgacatttaatcaaacccagctattgaaagcgatcgccaaggaagggatcgtccgggaggtcaatgctgccgccttcatcaaaaagtatgatttgaaggcggtgagtaacgtgaatacttccttaaggatattaatagataaggagtttatattgaggcaaccggatgggtatatcgtgtatgataggttcatgtctatttggctcagccggatatgacaacggatgaaaaatatttagttgacacagttcgctcgtaccaccaaaaattattccattaatattatgatgggattatcttcttctgccaatttctggagatcttccctatgcaatagttcgttaagttttgaattaacaaataaaaagtaggtcaagtcctcccgattcattatattaagggtttccacatcctgaaaaaatgaatctgaacgaacttgaccaatatttagagctaataaatagtgtgctgcttaaatcagcggtaaagctaaacaaatggcgtgagaagtttatgcttgaagtcctacttttatatttgattatccccgggcggattaatttccttcaaccgggtcgttatggtcgctttggtgaacaacgctatcggactttcatgcctgcttccacccggaagtggttcaaacaccgccgataaaaacaccggagcaagttacatacacattaatagactggtatctacatgtgccgtgtacacgcaaggaaacacttcagcgactggcaaactatgtggttgcggatgcctacttctccaaatccacctttgtgtatggcgcatttgaaatgggatttcatgtaatcagccgatttagagatgacgcctatttccgttatctcatcacggaagagcctacaggtaaaagagggcggcctaaattatatgacgggaaaatcgagatggagcacttggaagaggacagatttgaaatcgtcaatttggagaatgggcaaggacgtattctttcagcggtagtgcattcacgttcattgaataggaatatacggttgtgcattcactttttgttctttaagtgcccggttgtcaatagcatctcaatgggatagggttggtatctcaaagggataggtttgtaaagtcaatgggatagaggtgttgtctcaatggctttgcggccgtgtcccattggcttttttgtatcccgtatcagggatgttgctgataggttagggctcaaagggcgcatctttatgtatgtttctaaaactttttctgtaaataacgtttatacccctcttgtctgtagagtgatgtaaatattatttttctaaaaatgtttctttgaaagcgtaaagatgcgccttttgcgccctaggatttttaccggggaattttcctgatgccttaacatgtggatatacagttgtttgtgtggttcttccctcttcggctttttgggtctttggggggcgatataatgggtccttacccacgtttacgtgatccgaaagcactaaaaccaagtgcatttcgcatgatttcatgagctaaaagccgttttttctgtgtgatttcctatcggggccaagatgatgttcatcgtttttattacgtgcgaatgtactcgtggagcacttgtttcaagtgcgtgtggtgacacgttaggccacgtggtgggccacatgagccaagaatggatatcgacgtattattaacgtatgcgatccccctcgtgaaaaaaaacttgaaaaataatgcccgataaatttggaccgtatgttttatagcattacttttgcacccgcattcgagagagaacggcgcttcagaaatgatggaaacgtggaggtatccttgggtaggggatgaggttggctaggccaagcgataatttccaaccgcccggagatcggcttgagaaaaaaaacttgaaaatttttcaccgaaaaatttggaggttaagaaaaagtccttacctttgcagccgcaatcgagaaacgatagcgagagggttctttgagagatttacataattcaacaagtagtacaagtattaggagaagaaattttccggatcgataccgtcaatagagtatgactttggactacgataaacggattccggagcgaggatatgataaaacaatttaaacaacgaagagtttgatcctggctcaggatgaacgctagcgacaggcttaacacatgcaagtcgaggggcagcacaggtagcaataccgggtggcgaccggcgcacgggtgagtaacgcgtatgcaacttgcctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactgggaggcttgagtatgtttgaggcaggcggaatgcgtggtgtagcggtgaaatgcttagatatcacgcagaaccccgattgcgaaggcagcctgccaagccattactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattttgacagctctggaaacagagcctctagcaatagcgatttgcgaggtgctgcatggttgtcgtcagctcgtgccgtgaggtgtcggcttaagtgccataacgagcgcaacccttgccactagttactaacaggtaaagctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgaaaggatcggcctagggtaaaactggtgactggggctaagtcgtaacaaggtagccgtaccggaaggtgcggctggaacacctcctttctggagcttcaggattccgtaccgaggtcatacgaggtattgatcgccttgtgctgctgttgagattatgtttatatatagatcttacagaccgggaggccggtcggagagaaaaagatgacgctgggacgtaagtcttggcaaagttgacagtcctatagctcagttggttagagcgctacactgataatgtagaggtcggcagttcaactctgcctgggactactccgaatgagggggattagctcagctggctagagcatctgccttgcacgcagagggtcaacggttcgaatccgttattctccacagtttattgagagggataggcatcagccaatcccgtcccgacgacagtcgggctcagtaagaaggatctttgacatgttggacatcaaaaagaagaaacaagtagagcgagcttaagatatatcaacccgtgcgtcaagtacgaggtgggagaaagtaagcaagggcagacggtggatgccttggctctcggaggcgacgaaggacgtgataagctgcgaaaagcccgggggaggcgcaaatagcccttgatcccgggatatccgaatggggcaacccggcaggctgaaggcctgccatcccgtaagggaggcgaacgtggggaactgaaacatctaagtacccataggaggagaaaataaacaatgattccgtaagtagtggcgagcgaacacggaagagcccaaacccatgtcgtctaggcgacacgggggttgtaggaccacgacgtggcaagatagagtcaagtggaacgccttggaaaaggcggtcatagagggtgaaaaccccgtacacgactgacgattgaagcctagtggcatcctgagtagcgcggggcacgagaaatcttgcgtgaaacagcggggcccatcccgtaaggctaaatactcccgagagaccgatagcgaaccagtaccgtgagggaaaggtgaaaagaaccccgagcaggggagtgaaatagaccctgaacccgtctgcctacaagcggtcggagcgtcgtaatgacgtgacggcgtgccttttgcataatgaacctacgagttaccttccccggcaaggttaagttcttgaggaacggagccgaagcgaaagcgagtctgaacagggcgccaagtcgggggggtagacgcgaaaccgagtgatctacccttggccaggttgaaggttgggtaacaccaactggaggaccggatgggtaagcgttgaaaagctttccaatgagctgagggtaggggtgaaaggctaatcaaactcggagatagctcgtactccccgaaatgcatttaggtgcagcctctttatagtatatcgtgaggtagagcgactgattggatgcgagggcttcaccgcctatcaagtccagataaactccgaatgcgcgatatatatttacagggagtgagggcgcgggtgctaaggtccgtgtccgagaggagaagaatccagaccaccggctaaggcccccaaatgatcgttaagttgaactaacgaggtcggatcgcagagacagctaggatgttggcttggaagcagccattcatttaaagagtgcgtaacagctcactagtcgagcgatctggcgtggataataatcgggcataaacgatctgccgaagccgtggatgtcgcaagacatggtaggggagcattccatgcggcgtcgaagatgagggatgacccttgttggagcgcatggaaaagcaaatgtaggtatgagtaacgataaggggggcgagaaacccccccgccgaaagaccaaggtttcctgatcaacgctaatcggatcagggtgagtcgggacctaaggcaaagccgaacggcgccgccgatggaagaatgggttaatattcccatactgcctcatggagtgacgtggagacggagaagtgacagtcctgccggctgacggaatagccggttgaagggtgtaggtgtcgatcgcggtaggcaaatccgccgcgagagccgaacctgacagtatacggagcgcttgcgcgacgtaatatggacgtaaccatgctcccaagaaaatccgctaaacttatccatgcggcacccgtaccgtaaacggacacacgtggtcgggttgagaatactgaggcgctcgagtgattcacggttaaggaactaggcaaattgaccctgtaacttcgggataaagggtcctcgtcgtaaggcgaggcgcagagaataggtccaggcaactgtttaacaaaaacacatggctgtgctaaatggaaacatgatgtatacagcctgacacctgcccggtgccggaaggttaagaggagatgtcatccgcgaggagaagcgttgaattgaagccccggtaaacggcggccgtaactataacggtcctaaggtagcgaaattccttgtcgggtaagttccgacctgcacgaatggtgtaatgatctggacactgtctcaaccgtgagctcggtgaaattgtagtatcggtgaagatgccgattacccgcgatgggacgaaaagaccccgtgaacctttactatagctttacattgagtttgggcagacgatgtgtaggataggccggaggcattgaagcaggtacgccagtatttgtggagccgacgttgaaatacggcccttcggttgtttgagttctaactcctagttaggaggacactgtatggtgggtagtttgactggggtggtcgcctccaaaagcgtaacggaggcttctaaaggtgccctcagaccgattggtaaccggtcgcagagtgtaatggcataagggcgcttgactgggagacatacaagtcgatcaggtaggaaactagagcatagtgatccggtggttccgcatggaagggccatcgctcaaaggataaaaggtactccggggataacaggctgatcattcccaagagctcatatcgacggaatggtttggcacctcgatgtcggctcgtcacatcctggggctggagaaggtcccaagggttgggctgttcgcccattaaagtggcacgcgagctgggttcagaacgtcgtgagacagttcggtctctatctatcgtgggcgcaggagatttgcgaggctctgacactagtacgagaggaccgtgtcggacgtaccactggtttaccggttgtcccgccaggggcaccgccgggtatctaagtacggatcggataagtgctgaaagcatctaagtacgaagccggcctcaagattagatctccctcaagggtggttatagacgatgaccttgataggccacaggtgtaagggcggcgacgtccgagccgagtggtactaatagcccgggactttcctcacagtgaaggttgatatattttaagacgataaggcgaagctggtctcttcggattgatgtccggtcaaaatcttgataatgatattaaggtggctatagcacgagggatccacctcttcccattccgaacagagaagttaagcctcgtcacgccgatggtactgcgtaacagtggaagagtaggtagccgccgtcttaggtgaaaggagtcagtcgaaagattggctcctttttttggtatatacaccagccgttgtagagatgtggcacgctacgtctttacaaagagggaacgtggatagattagtcgtttatttctttagctagagattcccgtagtttccgtactgccgtggcgatgtgggcttctaatgtctttactgatatttctaggatatttgccgcatccttatatttcatcttatcttcacggatcagtttaaaagccatcttgcatttatccgggagcgtattgatcgcctcatttaaatgatcgatgcattctttagaaataagttcttcctcgggcgtagtatcggtatgtgcgaataaatcgatcgtattctcatcgatctggactttctccatatgttgtgtccggtataggctgatggctttgtggcgggctatgccatagatataagaatcgaagttagagatctccggtaatgactttctattattccaaagacttagaaatgtatcagagacaatttcctcagcttctacagaggaaggcacataaagggatgtaaaccgcattagcctctgaaaataggctaaataaagcgatttaaaagcagtttgagaatcggatagtgcgatttcacagacccattgcattatttctttggagtgtttttccaagtaactagaatcttgttaacttatttcccttctaaatatatagtcgcaaatgtatataaaaacccttagtggatctctctcttaaaagagaaatacttgatgttaatttcaacctaatttcatatctggttgtttttgaatctaatccgcaggttgtaacatcattgtaatatgtatgtaacggatgcgaaataattgtttcagaactttgcgcaagaattataacaatcagtatggaaacattttatttgttcttggtcatatttttgtttgtattggccatcgtagatttatcggtcggtgttagtaatgacgccgtgaatttcttgaattcagctatcggcgcaagagccgcatcctttaaagttattatcgctatcgctgccgtgggagtctttgttggtgcggcgttatccaatggtatgatggatattgcccggcatggtatttatcaaccccagcatttttatttctcggagatcatgtgtatccttgcggccgttatgcttacggatgtggtgttactggatatttttaactcgttaggtatgccgacctcgacaacggtttccatggtgtttgagttggtgggtggaacggtagcgattgccttggtaaagatcgctagttcttcaggcgctttgcaattgggggatctgctgaatacagagaaggcttttaccgtgattctgggtatctttctttctgtggcgatcgcttttttctttggtgtgatcgtgcagtatctgtcccggatcttgttctcatttaattataagaaaagttctaaatattttattggtctgttcggaggtttagcggccacttccatcatttactttatgctgataaagggactgaagacaagttcttttatgacgggtgagttcaaggatatggtgtatgccaatacggggatgatcgttttgggatgtatggtattttttacgatcttgatgcaggtattgcattggttgaaggtgaatgtattcaaggtggtcattttgatgggtacgtttgccttggcgttggcttttgccgggaatgacttggtgaactttatcggagtccccttggctggctattcctcttatatggacttgatggcgcagggagggaccactaccacggatacatttttgatgacctccttgttgggaccggcccagacaccttggtatttcttggtggggtccgggatcgtgatggtaatcgccttggctacctccaaaaaggctcagaacgtggtgaagacttccttggatctgtctcgtcaatcggatggagaggagtctttcggtacatcgcctgtcgcacgggtattggtacggaattgcagtaatatatccgctacgatattaagtatcgtgcccactccggttaagaactggattgatagccgtttcgaccaaagcgagatgatcatggatgacaaggctagtttcgacttggtacgtgcctcggtgaacgtggttttgtccggattgctgatcgctttgggaacctccttgaaattgcctttatctacgacgtatgtggctttcatggtcgctatgggtacttcgttggcagaccgtgcttgggggcgtgagagcgccgtatatcgcatcacaggcgtattgtccgtgataggtggttggttcattacggcaggggctgcttttacgatctgtttcatcgtcgctcttttgatttattggggaggtattccagctttggtcgctatgattggtttggcgatctattcgttggttcgtagccacttcgcttataaggctaaattgcggaaagaggcattgaaggaggaggtgaattctacggtgtctaaacttcgtaaggctacggatacccgtgaggctttggccctgttccgcgagcatagccgtgaggaattacaatccgatctggattttacggcggaagtattcggtaaggcggtaaatggattcatgaatgagaacctccgtgagttgcgcaaggtcttgactgccgtggaagagaagaagattcacttgaagcaagtgaaacgtgtcggtacgcttggcgttacccaattggatcacgatatcgctgtggagaaggggctttattattatcaaggaaatgacttcgccagcgagatcatattcagtatccgtcgcttggcagaaccgatgaaagatcatatcgataataatttcagcccgttgagtccggtacagaaagatgattttggtaaggtatctgaacaaatcatctccttcttgagaaattgcgctactatgatccgtaaaaacgattatattggttttgaggagctgatcgctgagtcgattaccttgatgaaccaacttaccgccttgaagaaaggggagttgaagcgtatccaagggcagtccggcagcacgaaggtgagcatggtttatttgaacatggtacaagaggcccagaacgtggtttcttttacggcgaacctcttgaaggtgagtaggaagttccagaaggaataatcagtctctattatattgggatggtgggagacggggcatgccccgtctctactggtttatagggttagcatcttcttttctttgactaaatcactctcgtccatccgcagggatgggactgtacacatcttgataaaatctcctgtttggcaagtataatcatagtaggcctgttgttccggggtaaaatcttctttatcgatcagtccgcttttccggctcatgaattcatcgatctccgtgctttctgattccttgataagaaggattcggcgggcgatcgggttacgattataatcctgcccgatgtataatcctcgtaattggcggggattcttgaaaaatggtatttgcaggtatatcgttaccatcgtgaattggggcgcttggttctcgttcagcatgcaatggaaattctgaggatcgggcatgatcccgaatccccattgagcctctccataagcgctgatccgccctacacggacttgattatccgagggggagagtaggaagggttccatcttgaggcagtccgaggaggaagaaaggctgtaactggtatagattcctttgaaagcctctattttagaggcggagagccgtgtctcctccatcaattgcttggcgaaaggattatcttttaggctatccggttcggcgagctccatctggtctaggcgaaggatcatctcctctatatgggaaagcaaacgttttttcgacacgttattcactagggcgagcgccgagtccagcgcttcttccggcgggtaactcttgatgccctcgaaataattcggcaatacggtcgtatatagggaggacaatatgctgggagccatatcgatccagtcggctatctctttcatcttaaccccattgcttcgtagatattcgatctttcggtagaattcttgaagattgttcatgtgtttatattcttgatttaccttacaaaataagaggacatatgttgcgtttccgtttcatgaatgttacataaatatttctttataatttattgattcctagttgggtattaataatatacattcatgggttcagtaatatgtctgtaacatggcggctgtacttttgccttcgaaaataaaacgacagaagattatggacactgcgatacagacaaataaaacatcccggaggcgggtttccgatctcttcttcatcctatgggccggaggggccgctttgctttcttattccttggtatatatgttgcgtaagccttatacggctgccgctttcgaggatctggaggtattcaatatggactataaggtggcggttacgatcgtgcagatcttggggtacgtggtgtcgaagttcatgggaattaagttgatatcggagttgcggcgggaagagcgcttgcggttcatcttgatgtccgtggtgatggcggaactttcgttggtattcttcgggttgctctcggctccttataatatagcggcgatgttcttgaacgggctttcgctgggatgtatgtgggggattattttcagctttatagaaggacgtaggatgacggatgtcctcgctagtctgctgggcgtaagtatggtgatcagttccggtacggcaaagtctgtcggcttgtacgtaatggatacgtggcaggtcagcgagttctggatgcccgccttgatcggggcggtggcattgcctttgctagccttgttgggatatgcgctgaaccggcttccacagcctacggaggaggatatcgccttgaagtcggagcgggagaccttgaacgggcggcagcgttgggagctttttaagcatttcatgcctttcttgacgatgcttttcgtggcgaatatagcgatcgtggtattgcgggatatcaaggaggacttcttggtgaatatcatcgatatgtccggttactcgccttggttgttcacgcaaatagatagcgtggtgaccttgactatcttggcgatctttggtttgatggtgctcgtgaaagataattttaaggcgctttcagtcctgtacggtttgattattacgggcatgatggtcatggcgttcgtgtcgttcgggcaggagcggatgggattgagcccggtgacatggcttttcttgcagagcctttgcctgtatatggcttacttaaccttccagacgattttcttcgatcgcttcatcgcttgtttcaagatacggggaaacgtcggtttctttattgtcttaacagattttctggggtacacgggtacgatactggtattggtgctaaaggaattcgtgggtacgagattggactgggcggtattttataaccaacttgccggatatgtagggatcttttgctgcgccacttttgtcgcttccttcgtatatttgcggcaacgctatcgcaaggagaccgctttatgtggctgcgaggaaatagcaactcttgagcctaccgaaaacaatgtccttacgatcgcttaaacaagaaaattattaaatacgatacatacagaatatgaagaagatttcaggtgtcattatggattgggccggtacggccgtggattatggatgcttcgctccgttgaacgctttcctcaaggtattctcggaagagaaagggattgatatcacttaccggcaggcccgtgagccgatgggtctcttgaagatcgatcatatcaaggcgatcttgagcatgccggaggtgaacgagaagttccgtgccttgtataagagggactggaacaagagggacgtggatgagatgtacactagtttcgagaaacatttgttcgcttccttgaaggatttcaccactccgataccgggagtcttggagacgatggcgatgcttcgcgagcaaggtataaagatcggctctacgaccgggtacacggcgaagatgatggagattgtccgtcccggagccgaggccaaaggatatagggtagataatctggtgacaccgaacgaggtcccggccggtcgccccgccccgtatatgatctataagaatatgatagatttagcgattccttccgtagatcaagtggtgaaggtaggagatacgatcgctgatattaaggagggcgtgaacgccaaggtatggagcgtcggtatcgtgaccggtagcaacgagatgggcgtgagcgaggaggaatataacagccgtccggcggaagaatgggaatctctgaagaaagaggtgcgtgagcgtatgttggcggcgggggctcatttcgtcttggatacgatcgccgagctgcccgcttgcatcgagaagattaacaacaggaattaagcttgataaccgaatagaataaaacaatcatatgagaaactatttattattgacaccgggcccgttgagtacgtcgcagacggtgcgtgaggccatgcttcaagattggtgtacgtgggataaggattataacgagggtatcgttaccccgatccgtaaaggcttgctggcgatagcgggattggacggggatgagtacaccagtgtcctgctgcaaggtagcggaacgtattgtgtggaggctacgatcggggccgccgtgcgtccggaggataaattattgatcctcgctaacggtgcttatggcaaacgtatggcgcagatcgccgattattatcatatcaattacgtactggtctctttgcatgagacggaactggtaaccggcgaggtagcccgacgtgccttggaggaacatcccggtatcacgcatctctcaatggtacatagcgagaccacgaccggtttgttgaatccgattgaggaggtagccgaggtgatcaagggccgggggattacctttatcgtggatgcgatgagcagctttggcggtgtccctatcgacgtgaaaggtttaggtatcgacttcttggtcagtagtgcgaacaaatgtattcaaggagttcccggcttcggctttatcctcgcccaaaaagataaattgatggcgacgaaggggaatgcccgctcgctttccttagatatctatgcccagtgggaagcgatggagaaagggggaggcaaatggcgtttcacgtctccgacgcacgtggttcacgctttctaccaagccatgaaggaattgaacgaggaaggcggtatcacggctcgttataagagatatcaagagaatcaccagatattggtggaaggtatgcgtagattgggtttcaagaccttgctgcccgatgatgcccaagggcctattatcacttcgttcttatatccttccgcggatttcgatttcacctcgttctacgcacggctgaaggagaaaggcttcgtgatctatccgggtaagatctcggatgcggatacgttccgtatcggtaatatcggagatatcttcccgaaagatatggaagccttgatacaatcgattaaagagatccggtaattgatgcccgtaacgtaacgagtccttcggggcccatattgaacagcaaatccgctatactcagattggggaggaatccgaatttctcccggaatacttgataataaggttccgggcggaaggcgggatcttccccttcgtgtttcgggcggatcgtttcccggaaatcgttggctacctccgattcataatgctcggtgtagacgactgcgggttgcatatccaacaggtcacagactagacggcgcagttcctcgttgaagtcgaggaggaactcgtatttcttttcgtagaaaggagcgaagtcatcggcataatactcgaaaaacggactcatattgtaggccgataccaaagcgttccagtgtaggtgccgccagtttccgtggtcggagatacggatgtccttggtctggcatttcaaggtatctggcttgacgatggggatggatagggagagtgggccgttcgcggcggcgatggaacaacggttacgataggtttgcttcacgtaattctcggcggtctcgatacggacctccgggtattggagcatcttacaatattgttgtatggggcctagataggcggtcgctatatatacaggtcgcatgattaatgaacgggtttaaagattcgttgtttgtcggggctgtaccagcagagccaagcgttgccgacgatatggtcggccggtatgaaaccgagatggcgggaatctaccgcctcgttggtattatcggacagtacccaatagtagtcttgttggaaaaagaagaaattagtctcccgcccgtccagatataactttccgtcacggaaggaagctttaccatccgtctcccgcatgatgatctccttgcaggcggtgagcgaggcggcgtccagcgggtaagcccggtctttccgtgggacgatcaacatgtattcttgcatttgttccccgataaaatgacggtttatggcgtcgggcaattcctccctcaattgatattcctcgaaagccgtgaggctgagcatacagccgaaactttcctgcctgaaatccctaagtgggatgtccaacttctctaacgtctccaagaacgtctccttggcgctcagtgttatgaaataggaacagagggagcgaggagagcgggggattttatgcccgtttatcgtatatccgtccatgctgacccggatcgtatcgcccggcataccgatgcagcggctgatgaataagggagcatccgcggaatctcgagagagcgggctggtaaaaagcacgaccttgccccggacgggcttattcttccccggtattttattgactaggatataatcccctttatgcaaagcctcttccatagagtccgtggagatgcgataggactctatgcagaaaaggcgtatgagcatgacgatccccgaggctagcgcgaaagctgccagccatttcatgagaactatcaggaatcgttggattgtcataatacgaagttttcacctcttaatccggatgaacccagcggaacaggcggttccaacggataccaccgtcgaacaggctgcgatccttgtccaaggatagccaaaccaagatcggcttgccgacaatgtgatcctcgggtacgaaaccccatgagcggctatctgcgctattatggcggttatcgcccatcatccagtaataatcgtatttaaacgtataggaagtctcgggcttgccgttgatgtagaccttgctgtccttcacttccaaggtgttgttctcgtaattcttgatacaacggctgtacaacgccagattacgttcgtccaacgggatggtagcccctttcttcgggatccaaagcggcccgaagttatcacgggtccagccagtattgtatccgaccggataggtagggccgcccaacgtctccggctcgatgataaccttcttcacggtaggtaacttctccgctatcgccaaggcctttttcgtgagtggcaggcgatataccgggttgtactgtcccttcgcgttaggcgtaaagcctaggtatgacaataggttttggtaataaccgccgctggaggccagcatacggtcatccttgcttacgtccatcaaacggaattgctcctctgtgatcggggaaccgtctgtttcgataaagtagttgaattgcatatctttcgggttctcggcgggtttaccgtctatgtacacttggttgtctatgagttggagcgtatcacccggcataccgatacaacgcttcacgtaattctcccgtttgtcgaccgggcggtacattacctcgccgaacgtggccttatccaataagatacgttcccgtccgtactcctcgaccaaggagtagtaatccgggttttgcactttcacggcgatcgtgtcgcctgcggggaagttgaacactacgatatcattacgtttcacgtggcccaaacctttcacccgtttgtagccccattccggccaatccagatacgatttacagtttaagataggcaacgtattttgtaccaacggaaaggagatcggcgtgttcggtacgcgagggccgtaacttaatttgctgacgaacaggtaatctcctaccagcaaggatttctctagggaagaactcggtatctgatagttctggaagacgaacaaattgatgaaataaacggctaccagcgcgaatacgatatcgtccacccattccaatacgttgcgtaccgtcgggttcttagaccgtttccaagctccccaagggatgtagtgcgtcaagaatatatcgactaggacgattaatcccagcagtaaccatacgttttgcatccagatagcgaacaacgtgtataatacggccgctatactaaacttgatccattgttttttcgtgaacttcttcatcttttagctaatacgtttagaatttgaataagtcattcatgcctaggaaacctttctttccggcggtaaactctgccgctattacggcgcctagcgcaaatccggcacggctcttggcatcatgcttgatactgatcgtatctacgtccgactcatacgtgatctcgtggatacccggaacctcaccctcacggatagcgtggatcggcaggtcggtcgcgctctcggcgttctctaaggtccagcggtctttacgatcgatattttccaagattccttcggccaacgtgatagccgttccactgggtgcgtccagcttgtggatatggtggacttctgtcattttaacgtcgtaggaggggaagttgttcatgattttcgccagatacttattcatggcgaagaagatatttacgccgatgctgaagttggaggcgtagaagaaggttttgccctctttctcgcatttctccttgatctcgccgatacggtccagccatccggtagtacccgatacgaccggcacgcctacctcgaaacatttcatatagttattgaaagcggtagccggggtagtaaactcaatcgccgcgtcggcgctcttgaacgcttctgaatatatatcctcagcgttattgatatctatgatggaaacaatttgatgtcctctttggatggcgatctgctcgatcgttttgcccattttcccgtaacctataagtgcaattttcatactttaattcaattaatgtcgcaaatatacagaaaatgaattacatttgaatccaaaatcttaactctgaaagaatatggaacgtttattacactatgtttggaaatacaaactctatgcgagtactccattgactaccaccgaggggcttcctatcgctgttatcgatcccggaatacaaaacaccgacgccggtcccgacttcttcaacgccaaggtaaaaatcgacggcacggtatgggcgggaagcgtggagatccacgaaaaagcttccgattggttgctgcatcatcatgattcagataaggcatatgactccgttatcttgcatgtaacgggtgtgaatgacgcatctatctgccggatgaacggtgagcctattcctcaattgatattatccgttccggaacctgtccggaaaaatatcgattggttattggtaagagaggtgcccgtcccctgcctcgagcggattcaagatgtggactccgtacatctggcctcatggatggatgccttgctcggtgagcggctggaacgaaagacagaggatatataccgtctgttggatcagtatcaagaggattggaacgaggtgttctatatcctattaacccgtagtttcggctttggcgtgaatagcgacgctttcgagtggttggcgaaaagcctccccctgcgatatatccaaaagcaaagggctagcgagtcgcaagtagaggcgatgcttttcggacaagcgggtatgctctcggaagagggctcctgccattactaccgtctgctgaggcgggaatatgagtttctccgccataagttcgggctcaagcctttggatgactccttgttcaaaagcctccgtatccgtccgaccaacttcccgcatgtgaagttggcgcaactggccgctatctggcatcggtacgatacgttattctcgatgatcctgtccgcttcttctcctaaagagatcaaggattatttccgtatccaaccctcggattattggaagaatcattatcatttccaatacgcctcggtggaaaaagataaaatgatcggggagaatgccttgaatatcctgttaataaatacggtagtccctctgctattcgcttacggcggtcgaaataaacttcctgagtattgcctgcgtgcgacccgcctcttggagagtatcccgccggaacgcaatcatatcgtaaccgctttcgctcgatccggtatcgaagtccataacgctggtgatacgcaatcactcatccagttaaaacgagaatattgcgagaagcgaaagtgtttgtattgccggattgggttcaggttgctaaaacgaagtgttaatcctcctcggtaaaaggagctcttatatacttgccgtctttatgattattggtgatataacgtaatatatcgatcacctttccggttgaaaaaacataccatgtggtatgcttgctgctttttcgtttgaaaaaagcgtattgcaaatctctcccgtatcggttgaacctcatttcagctgtatgggagagattataatgtggtgcatgaggtaaagtgtggatgaaatcgaggatatcatcgataagtatgtttgcgtactcaatgtatgaataataatctttctcaaataaggtgtcggctaaatccatcagataagtgattatttctttagggataataacttttgtgttattttctttgtgcgtttttttcatagaaatgttttcttagttcttgttttgcgtattgtctgaattcctcgatgctcaatcctttgttccaatctcgttcaaattcatcaaggttactatccgataggtttactcccaatcgtttcaatataggattgatcatatccccatatttctttaagtcgatgcgaacgtagctgttgttccctgccgcatctttctccaattcgatacctgatacttctgacatagttgctctatttatttggttatacttccatctattgcgaagatactgtttttaattaggtatctgccttatttcgggtgttttattttacaataagttcgatgtgaattactgttttgtaagagattgataaccggactcgaaaaaacacgtacatgttttttggaaaagtcgtacgtgttttccgaaaaacatgtacgtgttttcgggaaaacaagctgatgttttttcccggatgagccgcgatgatattctttaggagagaaaaatgacaataagggcttttctcttctgtgttacaaaaattagttggtgcggaatctgtgatgtgggaatatccggacaatgctttatttataacatgatatgattaagaaaatctctctttatctactcaaatatcttggaatagttaaatataagacctatatttgttgataggatttaacctattgttaataaagaaaggacggtggaagtaaacaaaaattttatcatgttattggcatatttatgccttagtcatatactgacgaatattcggggatacggagtactatatatgcttgatatctctgaggttggatcgggaagttatcagttaactggtaagggctttgggaggctatctttatggagttattgaaagatagtttttatatcgaatatttatgaacgtgcaatatgggatggagtatgagtaagaagtatatactgaggagtaaatggtttttgtctatggctgttcttttattatttgcgacatccaatgcgcaggagattacaaaggaaaaggaaccggctcggtttggtattggtatcgcctatggttttaaagatcgggtgaaggagctaatacatccgatagagcttacggtacggtataatctttcagaaaagcattcattttatgtgaatgtgccgttgggatggaaaagttggagagacgattatggttacgtagatcccgtcatacggggttactatactcataaaatgcgattgtatggcttgggcattggatatgattattccattgtgtcgtataagaacttagatctgtttgcgggtggaggattggaataccaaagattctattttcgatatcaggaggttcaagaaggaaagccttacccttttctgagagatagattcaatgattattctttatatcccaaagtgggattgagatatacgtggcgatttgtaggtgttgagtttgattatagatgctatttctccgtgagagggttggatcattattccgaacaattctcagatcttcctcgtgaagtggattatgatacacatatcgatcatgcttttcgatgtggagtgtattttttgttttaaacctttaaattgatttattatgaaacgaacaaagttgtttttatccattttggtatgttttcttttgctatttgcgacatccaatgcgcaggagattacaaaggaaaaggaaccggctcggtttggtattggtatcgcctatggttttaaagatcgggtgaaggagctaatacatccgatagagcttacggtacggtataatctttcagaaaagcattcattttatgtgaatgtgccgttgggatggaaaagttggagagacgattatgcttctgtagatcccgtcatacggggttactatactcataaaatgcgattgtatggtttgggcattggatatgattattccattgtgtcgtataagaacttagatctgtttgcgggtggagggttggaataccagagattttataatcgatatcaggaggttcaagaaggagagcctttcccttttcaacgtgatagattcaatgattattctttatatcccaaagtgggattgagatatacgtggaaatttgtaggtgttgagtttgattatagatgctatttctccgtgagagggttggataattattccgaacaattctcagaacttcctcgtgaagtggattatgatacacatatcgatcatgcttttcgatgtggagtgtattttttgttttaaacctttaaattgatttattatgaaacgaatgaaattgttgttatccgttttggtatgtttttttcagtatagttagtgcgatggcacagcatccagtgttaaaaccagacaaagacgtaccagagttcgttactccaaaaatgggatattattatgtattggatgcagggagtaatattgcccgagtaaattggactgtctcgggtgggtctttttcccttggttcatcccaaacctcaatccccggtgggaatttctatggtataaccgtatattgggataatgtgaagtctacaaatggtagtactcctcaagggaaattaacggctgaagtttattatagttcgggagttagcggagtgcagtcagcctcttacactcaaaaaataaaaagtttgaatggagtaactccgccttctcttacttcaaaaacttctactaatttagactatggagttcagaatataacagttttgcttggtcaaaaattttattacccgggacaaacaacaactggagataaaaatctggttactaaatatgagtagactttacctgaaggatggaaaagtggtactcaaacaggtgtatttactacttcttctgaatccatcaatattacgacaaataatgtcggtacaggaacagtcaaggtacgtggtgtaaatcaaggtgctgaatttgataaaagtgggtattcctctatatctttcactcgtaaatttggctttacggcttatccaacttctgttccttttggaaaaactcagactaatacatttaccactcaattagtgaaaggaatgacttatgaatggagtacgccctccggatggaaaatcaataatggaggaaatacgaaggaagggttggaatagaatagcgtaagtatcacctcaagtgtgtgccctacagatggaatagttaaggtccggttgaagaaaaatggtgaagtatctcaatggtataattgtccttataaaggaatttcagatccagcgataacttctacagctgcttaccaatttgaatatagtacgttagcgttggatgtcgcttcttcttcgttaagcaaggctacatggtccggaacgggtatatatgtggcatcagggcaaggaacagctgcccctaaagtgatatttacgaagtccggatctgttacggtgcaagctgttgttagcttgtcgggttgttccggtgtgcgaactatctctaagacatttaccgtatcacctttccgttatctgatttctggagaatccatgatttgctataatggtaattatacgattagtaatgtaactgttccttctgaggtacaattgacttggagctatactaatggcaagctagagatacagggaggacagagtacgaaaacagtatctgtagggatagctccgggtaagtttggagatgagtggatacgcttgaccgctagtttaggaggacaaagtgctgcggtatctaaagcgatttatgcaggatatccaacagtaactaaagttaccggaccttcgagtgtacgcctaaatcaaggggggagttttatagcgaatcctctttatgataatagtgtttgtgagtataaatggaccgtatcaccaagtcagggagcgagccaatctccttctcgtaatacaaattatataacattctcgattccgggcagttattatatagcgtgtcgtgcttatactactcagtgtggggcggcgggctctgcggcatcaacaactgtatccgtgcaaagctcttatatggtttattctgatggatccagtaaaattgtggatgtcatagaaaatcaattagagaatgacgagtcatctattttgtctgatgtggttgtttcaaatcaagtctcttatcagctatataatcaagcgacaggcctattagtcgctgaggggaaaatggaacgaagcgggggtacgcttgattttaatcaagtgaattccggcatatatattttaaggatacaagtaagcgatgcgatttttgaggttcatagagtagcgttcaaataattgagatacttgtagagcccctatctcttttatttaataggagataggggctttttcattttaagatagattaattagcgtatatatccttatcgttcacgggatttttccctatttttgtccctcaattgaaatgagagtattgaatggaagataaatatgtgagaaatagtttacggttctttataggggtacttctgctggtcgtgctgtattcgtgcgcgaatatagcctcgccgaacggagggccttatgatgaggctccgcctaagttcgtaagcagtacgccgttgcccggccagataaactataagggaaagaaggtggagattatttttgatgagttgatccagatcgataagcctaccgagaacgtgatcatcactccaccccaaatggagcaacccgttatccgggcgaacggccggaaggcggtcatcgagctgatggatacgttgaaggagaatacgacctatacgatagactttaccaattcgatctccgataataatgagaagaatgtattggagaattattccttcgcgttctctaccggcgaatccattgatagtatggaggtgtccggagtcttgctgaacgccgagaatctggagcctatgccgggtattacgatcggcgtgcatacgaatctggaggattccgcctttacgacgatcccatttgtccgtacttcccgtacgaacgacaagggagagtttacgattcgtaatatggcccccggaacctatcggatctatgccttggaggatgtgatgcgctcctacaagtacagccagcccgggcagcagatcgctttttacgattccttgatcgtccccgcgttcgagttgacgacccgtcaggatacgatttggaaagatagcttgacgatcgatacggtgatgacagtcggttatacccattttatgccggacaatatcgagttgcgcctgtttaaggaaaaagtagagcgtcaatatatgttgaagccggagcgtacggatgagaaaatactaaccttgcgtttcaatacctccttggatactattccggtaccggttcctttgaatttcaccccggcggatagcaattggtatttcttgcagacagcggaggaaggaaaagccgtgcattactggttgaccgattctttgatctggaagcaagatacgctgcaagtggaggtgaattacctgaaaagcgattccatgaatatacttcgtccgcagaccgatacggtacaatttaccatgcgtcgccgtcctgtggagaagaagaaaaagaaaaaagacgatgagccggaacccatcgagtttctgggaatgaacgtaaacgcttccggttcgatcaacctgtatgatacggtcgctgttacgtttagcgaaccggtagcggggttaacgaaagatcatttctatctggatcagaaagtggatacgctttgggaagccgtagacttcgatttctttccggatacgacgaactctttgaacttcttcatcaagcgcccgtggaagtatggagaggaataccgtttggaagtagactccgccacgatattcagtgcctatggtaaatggaacgatgtgtatagcggggaattcaagatcaagaaggaagatgagtacgggcatttatatatcaatattgagggagcggataccaccgctttcgtggaattattgaatagcagcgaccagccgatccgtaaggtgaaggtaaaagatggcggcgtgcttttcatggacttgaaaccggataaatattatgcccgtttagtattagacgtgaatgataacggtgtctgggataccggtaattacgccgataaacggcagccggaacttgtcttctattgcccgaagatattcaatatcatgcagaattggcaagtggaggagacttggaatatcaaggctacaccgatgaaacggcagaaaccgatcgatatcacgaagaataaaccgaaagagctaacgaaaaagaaaagagattacaaaaatgagggaacacagtcttcgtccaataggaacagcggtgtgggcggcttgcgcttctaaactgtatatatgcgttttctttttgtgtgtagcgagtcttacgtctttgcgggcacaaacgttgccgttatcccatggggaacgggtggattacgatctttattttaaatggggcctgatcatgtcgaaggccggattggctaccctttccgtgaaagaatcggaataccaaggagcgccgtcatggcattataacctgttgttccgctctgccggcgtgatcgagaaagtcttcaggatgcgtgatacgatggattgccattactcaaaggagcctcggctcttgttcagctcgaagcgcacgaacgagggagactactatctggtggataatctccagtttgagtatcaaggaagcggtaggatcgatatccactcgcatcgccatacattaaaggagacgaagatcgacacgatgctaatggcgaaagggcgtgtattcgatatgctgggagctacgatgtatctccgttcgctggattggcggacgatgagttatggtgcggagttccctttcatgatcgctatcggccgggagctcgtgaacgctcgtttccgctatacgggacaacagatcgtcgagcataaggaggcgaaattccgtacccgtcatttctatatcgatatctacgatgaggcattttcccaagccaaggaagcggcggaggtttggatcggtgatgacgagaaccatatcccggtaaagatccgggcgaaactgaagatcggggcggccgaggtctattataaagactcctataacctgcgtgccccgcttacttgccgtatcgtggtgcagaagaaatgaaagctttttagataggcttgtgtttctcgcacccagctcatcacggagctggggcgagagctttttatagaatttcttttttaaaccaacggagtgaagggtaattccgtgtctttgcggtaacctgtaccattaaaagtcgcgattaattcttcggcttcattggtgatacggacttcgcaattcgccagtctcttatggctgaacgcttctttcgcttccgcatataagtatcccttactctccgccttaaagaaattgatgtttgaggtaatggataatgtcaggcgtgcgtggctattagtcgccgcggcgaaagccagatccgccaacgtgaagatcgccccaccttgacatacgcctccaccatttaaatgttcgggcttgatgagcatacgcgccttggcgtaaccgttgcccgtttctaataattcaacgcccgcaagcaaggcgaatttatcgccttgaagaaattcatggattgtcataacctcttactattcgcttggtggattatttgcttagtttccattccgctccatccttggtatccttgatctcgaatcccatagcggttaattcgttacggattttatcggaagttgcccagtctttgtttgccttggcttgctggcggatggacagcaataaatccacggctttgccaaacgcctcgtaatggttgccgctggcggaagcctcgtctttcatgccaaggatatcgaacaagaataaatggaatacctcttgtaactctttcaagtcttcctcggacagagtagccttaccgtcttttacggaattgatcgcacgggtagcgtcgaatagatgagaaatcacgattggtgagttcaaatcgtcattcatggcctcgaaacatttctcacgaagacctttcgtgtctacggtagaggtagcggacggctgcaacttcatcaaatgtccgtatgcctccatcaagcgtgacaagcccttctcggcagcttgcaaagcctcattgctgaaatcaaccgtgctgcggtaatgcgcttgcaggatgaagaaacggatggtcatggcggaatacgcttgttgcaaggagggatgatcacccgtgaagaattgctccagtgtgatgaaattacctaatgatttacccatcttctgcccgttgatggtgatcatattgttgtgcatccaataatgaaccatatcatctccttgggaagccacggcttgtgcgatctcgcattcatggtgcgggaagatcaagtccatgccacccccgtggatgtcgaaatgctccccgaggtatttcttgcccatagcggtacattcgcagtgccaaccggggaagccgtcgctccacggagacggccaacgcatgatatgctccggctgggcgcatttccaaagggcgaagtcgatggcgttatgcttctcgtcctgcccgtccaacgcacgggtcgtattcaacatatcctcgatattgcgacccgagaggatgccgtatctatgatctttattatatttctctacgtcgaaatagacggagccttggctttcgtaagcgtagccgttatccagaatcttcttgactaactcgatttgttcgataatatgtccggaagcgtgcggctcgatgctgggaggaagtacgttcagcgcatccatcgcttgatgataacgattgaggtaatattgaaccacttccatcggctccaactgttctagccgtgccttcttggcgatcttatcctccccatcatcggcgtcgtgctccagatgccctacatccgttatattacgtacataacgcactttatatcctaggtgggtaaggtaacggaatagcaagtcgaacgtgatcgccggacgtgcgtgtcccaagtgggcgtcaccataaaccgtggggccacatacgtacatacctacatgcggctcgtgcaggggtatgaattgctccttctttctcgtaagcgtgttgtaaatattcaatggatgttccatattctattatatatttaggaatcgcgaacttacataaaatccttggtattatcaagctgatcgtgaatagtctgtagttttcataggcattcattgactcttgatgacttccgacggattctcgttggctgccttacatacctgttcacgtatcgtacctagaaccatgctggtaatggtgatgaatattcccaccaaccaccagatctggatttggatgcgataggcgtagccttgcaaccagtagttcatgacgagatagctgatcgggaaagcgatgattccggcgatgacaattaatcgcatgtattccttgaagaacaagaaaatgatctcggaggctttcgagcctaccactttccggatagcgatctctttacgcctccgtttcgtggaggctgtagcgacggcgtagatgccgaacaaggagattagcaaacaagcgaaagcgaggaatgaaaagatcttcaacccgactatctcggattggttcagttgatcgtaaagcgttccgatcggggtgatccgggtatccgctaatgtcgggtctatcttgggcagtagctccgtgatatggtgggcgatgtttccttcctcacccgctacgacccggatatacaaattattcaccagtccgcccgaaggaatgaatagcatcggatgaatgctctcccggaaggatagcgcatggaaatcgttgacgacaccgacgatttcgtattctttgatcacactgaaatcagaccaccacggcatacggatgatactgccgaccgggtcttgtaagcccatggctcgaaccgccgactcattgagcacgacactaagttcgttgccttctgtccaccaccggcccattaacatctttaggtcgaaggtctcaccgaaccggtgatcggttccatagaggtggaagtccacctttgtgtccagcggttttccctcccattccacattcgtgaagatcgccatgggatcgacatgatgttgaggcttaaagttcgtgtcggtgaaacttttgacctgcggcagggcacttaactcttgcatcaacgtggattctattttcccggatacgtctacgaagccggatagttggataaggccttttggatcgaaacctaaatctttttgatttacgaatcgcatttgctccatgacaaccagcgatgctacgatgaacaggatactgatcatcaattgtaaggttacggccatgcggcgtaacaaaaggggtttgactgtctctttgggaacgagcgaggtggttgccgtatggctgaactgcccgaagaatactaatcctgcacattggaggatgagaaatgtacctatacctacccctgcgaaaagaaacaggaaccggcccatctccaaatcaatctccagccatcgggcgaaaagcggcttgacttggactatgaagatcaaggctaccaacaaggatgcaagtacggaacagcctagctcgacagacatttgttcgatcaattgctttctcgttgcgccgttgaccgtccgtaaacgccattcccgcacacgttgccgaaagagatccatgtaggaattcaagaaattgaagagggcggcaaacaataatagggcaccagatacgacaaacaagccgatgaaatttaaggtgaagggtgtatcttcattcagatgatgccggatctcacggatggggagtgttcgcaactcgatctccttgttcaccccgatacgttcaggtagctcttttagttgattggcgaaggcttttgggtctgagcttggatggagtttcacgtataagtccatcacgaagaagctccattgtgcctccggaggtaactgggagaaatgctgtatcatgttatggttgatgatcgcgtcgaacggtagattggtatggggtgatgggtctttcaccacagccgtgacgatgtagggaggtaaggaggctctcatcaaggtgtgtatcggttgcccgatcgccttttccgcgtcgccaaatagacggaccgccgtacgttcgctcaagatcatgttgtttacgatttgtagcggatgattcatttctccacaaacgaaagattgcgggaatacctctaggaacgtactgtctgtataaagcatattcatttggatataaggagtcgcttgggtacggcagttttcggttgaaagcataagcgtggtggaggcttcgatagctgggacttgctctcgtaagctattctcgatacctttcgaggctcctttgttcactttcccggattgtttctctacgctatagacacggtagatggattcggaatccttgtagaaagaatcgtaagtggtctcatgatccatccaatagagtatgggcacgaaacagacgagggcgaaagccagccctaggatactgatggaggcgctgactttatacttccagatgtttttgaaggcaatgacacagtaatgtattaacatggcaattccgtttttttgatgatatcgctgatgactcaatttcgctgaatccgattcaaatatcatgccataaatgtaacgtattagaaaatagaatcatagaaaaatctgtatttcttcatgtagtgcgatagcgtacattttttgtgcgataatgcacatacaagctgtctttattccctttatctttgtccgtatggaagaaaaggggaaaatattgatcatcgacgataataaggatgtgttgttcgcattgaacttactgttggagccgtacatgcaaaaggtgaaggtaacgacacaaccggcacgcatcgagtatttcatgcggacgttccaaccggacgtggtcttgctggatatgaatttccatcgggatgccgtgagcgggcaggagggttttgagtatttgggacaaatcttggagatcgatccgcaagcggtcgtgatcttcatgacagcctattcggatatagagaaagcggtcaaggccattaaggttggcgctaccgatttcatctccaagccgtgggaaacggagaagttgctggctaccctctcgtcgggcattcgattgagccattcccgtaaggaggtcggacgtttgcgggagcagatgaaagccatgaaggaggacgacacattgccggaattgatcggtgagtcgccggctatgctgaaggtaaaagacacgatctacaaacttgtggagaccgacgcgaatatattgattaccggtgagagcggtaccggaaaagatctggttgcccgtttgttgaggcattactcgccccggcgtgacgatgctttcgtgacgatcgacttgggaagtatcccggaacaattatttgagagtgagttgttcggctatgagaaaggtgccttcacggatgcccgaagatccaagccgggacgtatggagatggcttccggcggtacgctctttctggacgagatcggtaacctgtccttgccgatgcagtctaaattgttgacggctatagagaaacgtcatatcacccgtttgggagcggtggaaccgatctcgatcgatgtccgtttgatctgcgccaccaacgccaatctgcgtcagctggtgggcgaggggagtttccggcaagacttgctctatcggatcaataccatagagatagccataccaccgctgcgtgagcggggagaggatatcttgatgctggccgatcatttccagaggctgtatagccggaaatacaagaaaacgatcaaagggttgagccgggaggcggggagtaagttgatgaaatacccttggcccggtaatgtccgggagttgcagcatgttttggagcgagccgtgatcttgaacgagggcacggtgctgagaccggatgatttccctctctatacagcctcttacgagcggaagaaggagctggaccctgatttgaatctagagcaagccgagcggaaaatcatcgggcgagccttgcggcaaagcaatggtaatatgagctatgccgccgagctattgggtatcacccgtttttccttgtatcgtaaaatagagaagttcggcttatgagatcgtatgcgttcacggtcatctcgcacatcgtaggcatcgtcttgtctacgggactcctgttctattgcgtgcatgaggagattatcttttgtcctactttttgcgggatcgcgatcttgtatttctcgattcatctttatttcatacagatgcggcaggtgaagtattggcgttatgtggtggattgcttgcggcagcaagacttgatccagatcgttcgttcaccttacgaggataaggtgatgcgggagttggcggacgatttgtccgcagccctgcgatccttgcgtggccgattgatggacgaggaggtgaggcggcagtattttgagagtctgttgaataaggtggacactgccgtactcgttactgacagggaaggggctattgaatggaagaactgggccgccgacgcgttgctggatacgaggtgtcggttacccaatgagttcttggaggctatcaaggcggggaagacggtggtgcgttacggaaaaccatccgttccgcaagattgggcgatcgatgccactcgtatcgacttgcgaggttgcgagcgttggatcgtcagcttgaagaacatccattctaccttggagcggaatgagatggaggcttggcagaaattgatccgtgtcttgacgcacgagatcatgaactccatcacacccgttatctcgttgtccgagaccttgagcaaacgttgcaaagcagatccggatgatgtccggaatcgttcgtatatccagcatggggtaaatgtcatccatcgccggagtaaagggttgctggatttcgttgagaattaccggagattgacccggatcgcctctccggtaaagacccgtatcttagtgaaagatttcttttcggatttaaggcgtttgtgccctgagccttctatccgtttccgcttgccggacgagcctctggaatggttcgcggatcgggcgcagatggagcaggtcttcttgaacttactgaagaatgcttgtgaggcttgtgcggaaaagccaaaccccgagattatcgtggcggctcagcgggagggaaacgaactcgtctttaccgtgcgagacaacggtatcggtgtcttacccgaggttatcgaccgggtttttgtacctttcttcaccaccaagccctccggctcgggtatcggtttaagcatctgtaagcaaataatcaccttgcatggcggccatatctcggtagaatccgagaatggaaagggtagctgtttctttttgtactttaattgattatcagcctattgcagtttttctaaatttcttatacggaaaactttagtttcttcaaggaaaaactttcgtttctatatagggaaacaaaagtttcttactgaggaaacttttgttttattaggagaaaactcaggctgctattataggagattcgtgataggattcatgagacggaaagttattgtctgtttttagtgcgcttaccctgtaaaatacataccttcgcggatatatttaattgattttctatgaaatggtatctatggggggcagttgtcctgctttattccctgtttggaagcgcttgttctacggaacggaggtatgatttgtcggcttatggtttatccccggtcgagaatgtggataatgcgcccgctatggcgagggcattggagcagatacgggagaaatgcgaggaaaaccagaccattgtggtgaccttgcctaagggccgctatgagttttatcccgatagcgcggcggagcgtgtctatttcatctcgaatcatgatcaaatgaatccgaagaaagtaggtttgcctttcgaggggatgaagaatatggtgttcgacgggcaaggctcggagttaatcttccacggcaggatgttgccggtctctttgctggattcgaggaattgtgtcttgaagaatttcagtatagacttcaagcatcctcagatttcacaggtaaaagtggtggagaacgatacgctgaaaggcgggatcaccttcgaggtggctccatgggtacgctatgagatacgggatagcgtgtttgtagcgaagggagaaggctgggagttgactcccggttccggtatcgccttcgagggagatacacgtcatttggtgtataatacaagcgatatcccggtaggcgtgcggggcttgatcgaggtttctccaaggctgataaagtctccccgttggaaagacagccgtttggtgcccggtacggtgatcgccatgcgttcttgggaacgtccggctcccggtgtcttcctgtatcatgacgtgaatacgactctggagaatatcaaggttcattatgccgagggaatgggcctcttggcgcaagtgagcgagaatatcacgctggatggtttctccgtttgcttgaaaggggcggacgatccgcggtatttcacgacacaggcggacgctacccatttctcggcctgtaagggagcgatcatctccaagaatggcttgtacgaagggatgatggacgatgctatcaatgtgcatggaacttacctgaaagtggtgagacgagtgaatgactcgaccttggtaggccggtatatgcacccgcaatcgtatggtttcgaatggggaagggtaggggattccgtgcagttcatccattcgagcaccatggaattgataggggcgagaaaccggattaccgctatcaaggcggtagatcaaccggattaccgaggggcgaaggagttcgagatccggtttgagaatacggtgaatccttcgatccatgagggaagcggtttcggcatagagaatctggagtggacgccgacggtcctattctcggataacttaatccgtaataaccgtgcccgcggttccttgttcagcacgcctcggcaaacggtcgtagagaataatgttttcgatcatacctcggggacggcgatcctgctgtgcggtgattgcaacggctggttcgagaccggcgcttgccggaacgtgttgatccgtaagaataagttcatcaactccttgacgaatatgttccaatttacgaacgctattatctctatttatcccgaaatcccggatttagcgtcgcaaaggaaatatttccatagtgatatcgtgatcgacgcgaacgagtttattacgttcgataggccattggtatacgccaagtccgtggacgggttggtcttcacgaataatattgtcaaacaaaataaggaatacccagccttccattggaataaccatcgtttctatttccagcgggtgatccattcgaaaatagagaacaactattttgatgaagggtttatccgggagagggatgtcttagaggaaaataacggatatgatatataggaaattaatcgtcttggtaagccttttgataggcttcgtaaacattgcgttcgccggcgttggtgatctcgatacgttaaacgtacgttctcaagcccctgtcaaggagagaatgcctgtcgtcgcctataagtttaacccgaaaagcttgattcttccggcctcattgataacggtgggagccgtaggcacggcgattgacgggatgaatgactttcacctgttttcccggaaagattccgtgaagcaaatccatatcgacaattacttggagtggggaatgctcggttgggtatttgtctgcgaccttatgggaaaagagaagcataactgggtggaccaactttgcttggtcgctttagcggaggggatgaacggattgatggtgcatggactgaagaactgggtaaatgagcctcgcccggatggggcgccttattcgtttccttccggacatacctcgaatgctttcttaggggcgcatatggcttataaggaatttaaggatagctcacctatactcgcttactcgggttatgcgatagcggcgttcgtggcgggttcccgcttatacaataacaggcattgggtggcggatgtagtggctggtgccggcttcggtatcttgtcggttgagttatcgtatctgatctatttcccgattcgtaacgctatcgcccggcggatcaatcgaaatgtgaagaactgcccgatcgtggccgctccggtattcagttcgaatatggcgggattctatctgacttatcaattttaatgcgtcttatggatcaagcgcatgtcggcttatagagactggttgatgcgcaaaagctcctctatatgcgtgcggtcgttgctgaggcgtgggatcttgtgttggccgcctaatttgcctttctgcttgagccattcatagaaagcgccgtcgtgggcgataacgatttccagcggttggagggagatctctttataccgcttcgcctcatagtccgagttcagcttttgtaagttctgatctaataaagtggcgaattcatcgagagattccggtttcttgtcaaactcgataaaccattggtgccgtcctttcgccttatccagcataaagagtggggcggcggtatattcttttactttcgccccggttcgtaggcaagtcatggcgatcgctttatcggcgttatccaccattagctcctcgccaaaggcgttgataaagtgcttggtgcgtccggagatgacaaatttatgagggaataacgaggtgaaacgtaccgtatccccgatctgataacgccataatcctcccgaggtcgtgattaccatcgcatagtttttcccggtctctaccgattccagcggcaacacggtcggatgggcgttacccacctcgttcatcgggatgaactcatagaaaataccgtaatccggcatcataagcaaactggagtccgtaggatcgtcttgcagcccgaagaagccctcggatgcgttataggtctccatataatgcatcttattcgatggaatcaaggttttatattgctcccggtaaggctcgaaactgattcccccatggaagaagacctccagattaggccatacgtccgtaagatattccctacccgtttttttcaatacggccttgatcaataccaacatccaagaaggaacaccggataggctgtttacatccttattccaagtgttctccacgatcgccttgatcttgctttcccattcatccattaggataatgggtttcttggggacgcgtattaaattgacgagcggattgagattttgaagtaatacggcggataagtcgccttgatgagcctcggagtttagcggggaagggctatggctaccgcccaatatcaagcctttcttggagaagaaacggctttccgggttgttccgcagatagatggctacgcaatcaaagccgcctttatagtggcaaccctttaatatctcgggggtgacgggcaggaatttacttttgtcgttcgtggtcccgctactcttagcgtaccaccgcaccaccgaaggccagagaatattcctttctccgtttatcattcgggtgacatacggctttatctcgtcataagtctgtaagggaagacgttggcagaagtcagaataagagcgaatgcttttataatcatatttgagtccccattccgtcttgcgtgccgtcgaaagcagagcatgcagctgtttgcgctggatatggtctatatcctgcccaaatcgtccgatctccgtttgtcgatggcggaaaaggagcgaaatcgtctgtgttaaaatatccatgccctttttatttgttcgagtgcaaatgtaggcattctctttttatttatatctttgctaagtactaaattaacgttacgatgaaaatagggattctctcatcgggtggcgattgccccggtatcaacgctacgatccgtggtgttggcaagaccgctatcatgcattacggcatggaagtgataggtattcatagcggttttataggtcttttgaataaagacgtccaagttttcgatgaacggagcttatccggcatattaaatttagggggaaccattttaggaacgtccagagagaagcctttccgtaagcttttggcctcgggagattcggaaaagccggagatcattaagaaaaattatgaggagctggggctggactgcttggtttgtatcggaggtaacggtacgcagaagacggccaatctgttatctcagatcggattgaacgtgataggcgttcccaagacaatcgataatgacatatggggtacggatattacgttcggttttaataccgccgtgaatatcgccacggaatctatagaccgtcttcattctacggctagttcacataagcgggtgatggtcgtggaggtgatgggccatcatgccggatggatcgccttgtatgccgggatggctggaggtgccgacgtgatcttacttccggaattgggatacgatatcgataaggtgaacgaggcgatcttggatcgggctcgcaggggcaaaccttattccatcgttgtagtagccgagggtatcgagactccggataaaaagcgtccttctgattatattacccgggctatcgaggcgggaacgggtatcgagacccgggataccgtattgggatacacccaacggggtggaaacccctctccgttcgaccgtaaccttgcgactcgcttgggaggccatgccacggaactgatcgctaatggtgaattcggacgtatggtttgtatgaaaggagatagggtagaatccattcccttgttagaagtagcgggaaaactaaaattagtgacaccggatcatgatttgatcgtacaaggaaagcggatgggggtaacattcgggaaataaaataaaaaaggttgtgcgttctctgacacacaaccttttttactttatactagtaggcggccgtttatttcttaataccttgaacggtttggcttcccttttcagtagtcaagcgaaagatatacattccagtggcaaaatcacccgtgctgagactgcttcccggttgcgggatgctacgtatcaactttccatcggccctgtagatctcaagcgatttcagttgttgataattctggatctgtacttcattcgagaagatacgtggttgaatgtctacttcttcgcctgttggcttcagttcgttacctacgctcgtttccggaattaccgtagccggagcgctctcgtcggtaccataaagtgccgttacttggagcagaggggtacttgttgccagatttttcaccgtataattccgttgagaaacaggtaatgtcgtcagttcccgagtatcttgatataccttataaccggtcagctccggaaaagccgtaatcaactctgcttcttgcgcatcggaggcgatagccagtttccggaatgataatcggcccgttctcatgggttgcggtttctccgagaaagtgctcgtggagaatacggaacttgaggggaactcaccttcttccgcgcttattacgatcgataacacaacattggcatctagctcatcatctgagaatgtttcccatttttttccgtccaaagaatataaattcccttttccatcgactgcggggccttcatcggaacatgccgggtatgtgttattggcatagcttatcacatgaatggctaccagtaaatcctgcttcgcgtcgattacgaatggtgttttaagtgtgaccgaatttattttacctgatttcagttgagtgaaactctcttcatactcccggtttccctgtttgatatagactccataggtgactccttcctgcggatagaaattaaccttccggatcgtttttttatgcaccggttgtagatctttcgtatcccatttctgagcgaaatagaatggatctcctccgagaccgaactgttgataacgatcttgtgatccccaaccagctattttttcgaggactggggcattccatgtcagttgaatctcacccgtggagatctgtttgtatttcaaatcagtcggactttcatactcgtttccgatcgttttcccatcctgcgtcattccctgcaacgaggtgacgcccgttccgagtggatctagccagacatccatccgggctgtatcattatcactgtatttattccagtgataatacaatttaccgtataaattcaatccttcgggcagttcgcaactggagcttccaccgctcagcgtacctataatcaaacctttgctattaaataaaggcgagccggaagaacctccctcggtcaccccgtgtccgtttagcgtggcatcgaaagtcgcgttccaatgagcgttcgtggccccggttttcccaacatcactattacgccatgtaatcgattctgtcggataatttccataggtggagattttcatataatcgccggaaggatgatggatgcctacgcccgagagtgaaagcatatttgaacgatcccatccgttaaagaatacattataatcgtcggggatctcgtcgttaagcaacagcaacagtccgtcggaaccgttttcgacaggggtagaggctttccgtgtacatcctaccatggtttttatcggataaatgggtgactcattatcgcagcccacatgttcttggtggaaataaaacaaccagactgctaattcctcgggagtaaccgtctgttcgcccagcatatcttgcgaacaatggaaggcggataatacataaggctttttgtcacgggccgtattatttaccagagaagccgtacaaatatagcttcctccttctccctctttattacggatgtattgaatcatttgtatcacccccttcttttgctcctgccaatcggctccctcctcgcaattgatattcacttcgcaagcttctgaaaagccggctcccggcgcttcctgtacttctggcatgatcgcttcaagatgattatacccgtaaccgacctcccggatgcgtagtcgaggtgtctcgccggatggtgccggtacatattcgaggatcacctcatcgcctgctacggcttgggttgcgaacggtccgttttcaggatgcgtacgatgcgtataggcacccaatacttgggttttcgctgcgttatacaggtataaccgggcacctttggggatataaaaatcggagtaatacaggatcaaggcgatcgctcctttcgcttgaaggtgaagttgccatacttggctgccgtcgggcagtgaaatccaatcgccactatcggcgatgtcgaagctggttgggatcgacttggctacacgcaacggagcgccttggctgaccctccacgcatcgaccgtcttgaggtcttccacactgaaattcactggaacttgttctgctagcttttcacttcgaagtgaacctgcgaattgaaagctgggggggagtcctccttcgctgatctgcgccaacgaacttgaaatcgagaaataaccgatacataacatgccggttattaatattcggagaaatttactgtactgttttttcatacatacaactttatatgagcttattcttatatagctaagaacttgggtatatcaaacgatgtacccaagttctgctgtttatcatacagtttcttcctctgggaggtcagaaaactctttttcatcggttagttcaccagtcttctttttctttgtggcagagatacgttgctggagttctttgtctgtccgcaatcttttgaccgccattttagaagccgcttgctgggattcttttttggagtaaccgatacctatgccaatttgctcgcccagcaatttaatcgcactttggaatacaggattcccatcatgatccgtaaaagactctattagatcgaacgagatcgatattttgttcttttggctccattcaatcaagtttgacttgaaatttatctctttccggacgagcatatctacatcgatatacttttctatcatcacgtcacggataaacttataacaaacgtcataaccttgatccagataaatagcgccgatcaaagcctcgagcgcattaccatacatatgattgttatgagagtttatcttggttgaatagactaccatttgatcgaggccgagttgtacggcgaccttattcatcgtttcccgttgtacgatcttggagcgtgtgtttgtcaaaaagccttcccgcttatttgggtagcgcttatagacaatatcggcgaccgccgcatccaaaattccatctcctaaaaattcaagacgctcattgttaagccatttaccatcacccgtctctaccgatgatgatttatgcaacaaggcctgctcgtaaatctggagattatccggataaaaacctagaatctttgataaagacaaataaggctccctacctttattatgcaggagccttattcttttatgtagctgtttgtatagctttctaaacacgttatttcacgaattttttaacaatggcgcaagcgttgtgtccaccgaaaccaaacgtattcgataaagcggctttcacttctctcttttgagccttattgaatgtgaaattcagtttataatctatttcaggatcatcgtcgccttccgcatggttaatggtcggcgggataataccatcgtttatagccataatacacaggatcgcctctaccgctccggcagcaccaagcaagtgaccggtcattgactttgtggaactgatattcagttgataagcatgttctccgaacacatctttgatcgccttaacctctgagatatcgcctacgggagtcgatgttccatgaacattgatgtaatcaatatcttccggagccattccagcgtcttccaatgcgttgcgcataaccagcttcgctcctaaaccatccggatgagaagcggtcaagtgataggcatcggcagacattccggttcctgcgatctcgcaatatattttagcgccacgagccaatgcgtgctccatttcttccaataccaagcaagctccaccttcacccatcacgaatccgtcacggctagcgctgaacgggcgagatgcggtctcgggagaatcattacgtgtcgataacgcgttcatggagttgaatccacctacacccgattcagaaacagcagcttccgctccaccggtgatgatgacgttagccttgcctaaacggatataattgaatgcgtcgctgatagcgtttgtagaagatgcacaagctgagacggtcgcaaagttcgggccgtggaatccataaagcatggaaatatgtccagccgcgatatccgagatcattttcgggatgaagaacgggttaaacttcggaccgatcgtatccttgatcttcgcataactcaatacttcctcgtcaaatgtcttgataccaccgatacctgaagcgaaaataacgccgatacggttcttatcttctttatccaagtccattgccgcgtcctcgatcgcttgtttcgccgcatcgatcgcgaataagctataacgatcacacttgcgggcttccttacgatccataactttcaacggatcgaagcctttaacttcgcatgcaaattgtgtcttgaatttggatgcatcaaactgagtaataggtccagcgccactttttccgttgataataccttcccatgtttcggggagggtattaccaagaggagtaatagctccaagacctgttactacaactctttttaattccatacctttagttaaaaggattgattacttcgcgttagcctcgatgtaagcgatagcgtcacctacagttgtaatcttttctgcttgatcgtcaggaattgagataccgaattctttttcgaattccataatcaattctacagtgtcaagagagtctgctcctaaatcgttagtaaagcttgcttcgtttgtaacttctgtttcttcaacacttaacttgtcaacgatgatagcttttactctttcagcaacttcagacataactttttcaatttagattaataaatacgaatatactttttaaatttgcagtgcaaagaaaagaattttttatgttacaaagcaaatttaataagctaaaaatgcggaaaactgcacattttttcttttcttgtgcatttaaacatctgaaaatatgaaaaacatagcgatttttgcttccggatctggtacgaatgccgagaacatcgcccgatattttgctaacagtgaaaacgttaatgttgcggttgttttatcaaataatcgtaatgttggcgtgcatgggcgggtaaataagttgggcgtaccttctttcgtgttttcacgggaggaatttattgccggtgtgccgatcttggaaaagttggcggaatatgatgtctgccttatcgtgttggccggttttatgaataagatctcagacgtgattcttcaggcttttcccggtaagatcgtgaacatccatcccgcgttactccctaaatatggcggcaaggggatgtatggcatgcatgtgcatgaggcggtcgtgaaggctggtgagcgggagtcgggtattactatacattatattaatgagcattatgatgagggcgctatcatcttccaggcttcttgtccggtattaccttcggatacgccggaggaggtagcctcgaaagtgcatgccctggagtatgcgcattatcctcatgtgatcgaaagtttactgtaaggcttttttgtcattagcctacttgaaaacctagtttctggagtacggcgaattcttccgggtcagctttgatcgcttggtaagcatggaactcacggggatggtcatacgctgccctaaatcgctcgaaatgatgaggattcgctcttagtgcttggtcgattacttctgggttgaaacttctcaagatggcttcttccacccggtgctccttgaattgtcccaagtcgatgaatgggttggttggggtaggcggaatgacttccttgatcttttcgatacggataccgaaaaagcatcctatattctctaggcacattcgtgtcccgttcgccttcccgtcggcggagaaaccggctatatgaggagtagcgatcgtggcttccgacagtaatttccggtcgatatccggctcgttctcccagcaatcgatgatcagttcgctgaccttgccggttcgtttggcctgcaataaggcctgcgtatcatgtacggcgccccggcaactgttgataaaccatggttttcgttccaatttgtcgaaaaaagcaggatcggcgagatggcgggtggcgaaacgtccctctttggtcaacggcacatgcaaggttatgatatccgcctctctcgcgatcgtgtccaaggatacgaatccaccgtcgccttcctgctcggcacggggcgggtcattgcgaagcacacgcatccccatggcctcgcatagcctctctacgatactccctacatggcctacgccaacgataccgatagtcttccctgctagtctctctcctttgcggagggcgacggctaccaaagaggataatacatattgccccacggaagcggcgttgcaacccggggcgttcttccacgtgatccctgccttctcgcaataatggatatcgatatggtcgtacccgatcgtggctgtcgtgatgaggcgaacccggctaccttccaatagctcgcatgtacatttatctatgctacgtacgatcaaggcatccgcgtcttttatgttcgtgggcgtaaactctttggagtcaaggtaggatacgtccgctatcggctccaagatcccttttaggtaaggaaccgtgttatctgctattattttcatcttatcagcttgattatcgttacgcgatattaagtaaaaaacaggggatatacaagtgatgggagtttcgcttcttgtgaattttatcatgcgcttttgttttcggaggaaggatcccgggaaaacacgtacgacttttccggaaaacatgtacgacttttcgcgaaaacatgtacgtgttttccggaaaagatcattctgtttttggggtattgattatcaatgtgttatatacggtctcctttttacgagcttattgtacggaattttattggggatccctgtattccagcttggcaaagacggatggttaaatgaaagagccgtatggaaacggtcataccccgttggttattttgtatcaaatgacataaactaaggactgaatgtcacaactcaaggttgtgaggaaggattcgtcattaaataaaggcgtacattgcgagtgtcaaaaacaaataatagatggaaaaaagattactgttatgtttattgtgtgtcgtgagcgtggccttctcgttggaggcccgtcagcgtactgaggcggaggcgttgaggatagcccgctctttttatgagggacagggtatgttacgctcggccccgggatccgattttcggttggtgtatacgggagaggggagcggcctgcgttccgtgtcgtccgatccgtattactatatctataatgtaggggaaggggatggtttcgtgatggtgtcgggcgacgaccgtgtcgccccggtgctgggttactccctgtcgggctctttcgatccgggagatatgccgtcgaacatgaggggttggtttgaggaatacgagcgccagattgatcatgcccatacgcagcttgaacaggtgtttccggagaatgtttcgtctccgcgttcagacgatgggtttccggagcgagtggagccgttgatacagacgaaatgggatcaaggcgctccttacaatagtctttgcccgttggatggggataagcgttcagcgacgggttgtgtggctacggctgccgtccagatcatgaattaccaccaatggccggagaaagcggtaggtaaagggcaatatcgaatgggagaggaaaatgtgaacgagactgttttctccgtggatttaagtggctatacgtttgactggaagaatatgctggatgtgtacgactctacttccaccgccgttcaagataaggctgtcgccgagttgatgtatgctgtgggcgtggctggtaatatgctctattctgctgctggcagcggaactatggacgaatatatggccaagggattgatcgagaatcttaattatgataaaaatctgctatgtctgcatcgtgactattatatgaccgcaggctggaaaaggttgttgaaagtcgagctcgcggccaaacgtccggtcttgtacggggggacgtctacgagtggtgggcatgcctttgtttgcgatggctatgataaggacggcctgttccatatcaattggggttggggaggagccgctaacggtttcttcgagctggatgtgctgaatccatatattaaaacgtatagcggattctcttatggtcaagatatgattatcggtttccagaaacccacggaggcgagcgagccttatctgtcgttgaatgttaattcggtgaatgtagatcgtccgtcgatctcgcaaggtgattctttgggcattgaatatgccctacagctagatgcctcctccgagaaggagctagaacttgctctaggagtctttaccggagatagtctatccaagatcgtttatgaggaaaagggcgttataagtccagttgtggtttcaccttcttttttgtggaagactgatccactatgcttggatccgggtctatacgggttgagggcgttgtatcgtgtatctggcgaaaaggagtggcgggagctaaccccttcaagggtgaggaataacgaaatccatttgttggcgacggattccttgatagaggtgatatcctacgctgatgaatatacagggacacattctgtctattcggaagagagcttggtagtggatggctcgaacgtgttgtgcacggtgattcgcaacgagagcgcctatgagcgtaatccgatgatagtcttcatggcgcattcgttgtctacgggggaatatacggacttgtctattgaaggcgcttactttcagtcaggggaagagaaagaggtacgtactcaaataaaagtaaacctatccccgggtcgctacgtgctggctgcgtatagtgtggtatctgatggtctctattttataaaaggaacagaggtatttgtaaccgtggaaggcgttcccacaggcatccatccattggcggttgatgataagcttcgggtcctggcgggagaaggccgtctgtccgtatccttcacgtctccgctccatgaggcttacttatacgatgtatcgggcaggctttgctctacgggcgtgatgaacgggacggcggggtccgtcctttctaccgctggtttatccggggggatctatgtgttgaaagtccgtatcgaacagggttgggcggagaagaaaatagtattgtgacaggtaccggaaagttttaacttcacgggagatctttatgcgataacagagaaaatgcaaaaatgaaaaaagggattatggctttatgcttcatcgcttcctgctgggggatcagttgttcctccagtcggaagcaggctgccgggttagaaacgaccgacagccggttttccggaatggtgccgacaccagcttcttccggacggatttcttcctccgtgcaagcggctcctcctgtggtgatctataagacggcgaaagattatagccgtcatgtcccggttggattgagtgaggatggccagacgattgtctcgtatccggcggtaagcgatgtgaaagtgggggataagtatccctacccgactcctttggccgatggctatctgttggataaccggggtatcgggcgcaacgtggctttcttgtcttacacgtacgaggaatacgcggccttgccatctacgccgtctcgctccgaattactggagaaggtaatcgataaacacccgctaacagagattcatacctgcggtaaccggtatcaatataaggatttggtgaaagaactgaatgagcggatacgctcgggggaatttaaggtttctttataacgtgatgcttatcttagcttgtgccggttgaaatgcggccctgccttgaacaaaaagaaaaacgtagacaataccgtaaggcaagcgccggacaggtaggcgtagttgaagccacccagctcttgtgcgatactgcccccggccatcaacccgataccgatacctacatcccaactagttagatatgtagacgtggccgtaccccgctggttattgggtgccagattcacgaaaagcgtgttgaaagcagggaacatggttccgaacgccacgccttgcgagagggctatacctatgtagagataagaggaaaataccggattccaatgcatcaactccttgagcgccgcaagaagaaagaatgtggccgccgccaaatacatcccgagggagataacaagcgtgatccgtcctttatccacttgccgtccggagaacaggcgggagacagcgagtcccacggccataaaggtgaaataaagtccggagtttacgctgatcccgatctcagcggcgtacatcgctacataagtggtagtcataccataaggaatggagagcaataatagggagatacccgcccaagttcccttcaccaagaaaaagcggtctagggagatcggttctcgtttgaccggttgcttataaggagtcttgaccatataggccatgataaaaccaaggcttccggatagcaacgagcaggaaaagatcacgtcgtatgtgaagttcccttgcatgaacagaccgatcatcggcccgaaactcatggcgatgttattggctaggccgtaatagccaataccttccccacggcgggaggagggcaagatgtcgatcagtatcgtatttccggccaccgtcaccatgccgaaggcgaaaccgtgtacgacgcgtaaggcgataaagagggtaagcgccgtggctaccatgtatccgccaaatatggcggtgaaaatgaaataagccaccagatataagggacggcgggcgaaagtatccagcaaatatccggcgaacggacggatacagagcgccgctagcgtatagcacgacaagataaacccgatcatagacttcccgatcatgaattcttccttcagataaaaaggtaagatcggcaggattagatagaaagcgaaaaaaagcaggaaattcgccgctagtatatagcaaaagctgggtgtgacgatcttatcattattcatagagacgtgtcgtttataaatgacgcgaaattagatgaatttattgaataaaagggcttaaagtaagttttttgtacgggattgggaccgattgctgcaaatagttaatttaattcacatgtaaggcttttttatactcggtaggcgtcatcccgatcttattcttgaagaggcggtgtaaggcacgtacgtttcccaatccggaatcgagggcgatggcttctaggttgtaataaggatattgtttcattagctgtatggagtgttccatgcggaggttgccgatatagtttgtgtaattgtcttccgtgttgctctgtatcatccgggcaaaacggtttttgtccatgtggagccgttttagtacgtcctcacgggtaagatctgattttagatagagtttctctttatgcattatttcttccaacaggatgaaagaatcttggtcgattggttgatctgggtcagtttgtgtcttgctatctgatttgggaagttcttcttggtgcgatagttctgcctctttgtcacgttccttgatcgccaatagctcattcttgtaggctaggagttggtttacttggttcactgtgatcttgttctttcgcttgatgaccttgctgttccggtacgagatccaaagcaagagaataaggaggattatgatgcctagagaggctccgagaaatgtgttgcgctgcttcagctccatttcctgcttgatgatcttggtttccttttcgttcgtctcataggcgatggcaagttccatggccgcgttttccttgtcgcgggcatacagttcctttcgtatgttggagagacgatcactgtattggagagctgttttatagtcccccattaaggaataggtattctttagcttcgctagcatcaccgtataatctttattgatggaatcttgcgccggagtcagtctctcccgttccaaggtgttatggatcacttgcttataatcatttattaatagcaggtaagggtccgctctcgttcttccctgcggcttttgggcgaatttggtggtgaggaacttttggtagtaactggccgctgcttgttcctctccgatcagttgatacgcttcgcaaaggaagctatataaataacctaggtgcatatccacccttgtctcttgcatgtcgcctgtttgttccatcttttccagaagtgcctctacttcctttccggtatttattgcttcttcatttttctcctggatcatgatgtttcgtagcttctccatataaagtgagatcaacgtacacttttcttccggatcggtggtgccttgtagcagttcaatcgcttggtcaagtgtctcgatagccttgtctttttgtgccagctcgttttgtgcccgtgagatggagatcatagaggtagcctcgacgctcttattgccttgggagcgtgcgatctgtatcgctttcgttgcgtattctatggcttcgttctggcgggatagctcgatatagcaattacttagtatctggcaaacattcatgtaggccgtggagtcgttttgtacggaatcggtgtggaatgcggctagagcgtattccagcgctttcttctcgtttttcaaccgggcgtatgcccgtgaccggatgatatgtgctttgtattccggtatgatccgtaggttctcggcgctatcggctaggtttatcgctttttcgggggttgcgatgatctgattgaatatggattggtaagataatttttcttgggggcggttatctgcggaagggtttgccgctctcaagagtacgatagaaaaaaagaataaagttatatatgttagtttcattcatttactttttagcgaacaaaaatataaatttttctttgatttataagtgttttttgtgacgattagatatgaaaagggcctagtttacctcgaatccggattatatgtcacactgtttttggactaaatgtcgtaaggtagcggggtttcttaatgaaagtccgcatttaaaagccttactttgtatcacaataagacagataaaatggcgcatttaaaatgtcgtggctggcgtgatgagacgagctttacgtcttaattgaaatataatggaaaagatggttaatatgaagagaaaatctattttgttatcgctgcttctagcgatttttgtggtaggagggatgtttgcccaagaacctacgtattccaagatgtctccctatacacgtattcttttagacaaattagcgaagaaagatacggcgaactcgttgttgaggagttctatctcgggagattatctctcggctttcgtgaaggtggcgacggatgagggatgggcttccttggattcggccgggtgccgtatccggacaaggacgggagatatcgctacggtgttgatccccctgtctgccgtggagtcggtgtctgagctgggttgtatccaatatgtatccgcttcacaacctatgagggccagtatggactcggcccgttactactcggacgtggcggatgcctatgcggggactaagcttccccagccttatacgggcaagggggtcatcgtgggtgtggtcgatcagggattagattttactcacccaaatttctatgacaaagagggtaaagcgtatcgtatcaaacaagtttgggaccaaacgagtccttatagtaaagcggaatacaggacggaagaggaactgctggatgcggcttgctcgtttgattcggatgtaaatacgcatggtacccatgtcgcgggcatagctgccggaggagggtttgatacgccctaccaaggtgtggccaacgagagtgatatgatcttggtggctactaccatgcagaattctgatatcgtagacggagtggactatatattcaaggagagcgagagactgggtagaccttgcgtggtgaatcttagtttaggggatggtattggaggacacgatggtactaattttatggatataatgttggaccgaatggtcggaccgggaaaaatcatcacggttgccatgggaaattctagggacatgccagtatataccgaacagatgtcgccttcggataccttgcatacttttgtaggcaggtctaatacgggtctttcttatggactggtggatatttgggcggacgagcccggggaacctttttctgtttgcctggatctgtatgatcgcgaaagcgatgagatattaaatactaccgggtttttcgccttggatacaatgcctaagtcttctgtttttactagtgagagcgtggatggcacgttggtgtatgaggcgcaaatggaatctgaattatatgtgtttaatgggagataccgtctttttattcagttcaattatccggaaggcaccaaaaatgaaaagatattcttacttcatgtggcgacaaataacacgccggtccgggcttggggcaacaatggcgagagcttatttacggacttgggaaaagggtatccttatacggtcggtacgggagatttcactgtcggctctccggcatcggccaaaaacgtgatagctgtcggggcttatgccactcgtatatgcccggtaaatgtagatgggggtacctcttatttggcaggtaatagtttgggtgagttaacatcattttcaagcgtaggccctacgcttgataatcgcatgaaaccagatataacagcacccggactttgggtggcatcctcctataactcattctatctggagggtgagaccggtgaaggagccaaggcatcacaggctcgctattccactttcaatggacatcgatatccatgggggtatatgagtggaacctcgatggcttgtcctttcgtgactggcagtatcgctctctggttacaggcgaatcctgctttatccccggatgatatcaaggatgtcttctcccgtacggctgttcaggataaaccgctctcttatccgaacaagcaatggggatggggaaagatagacgtgtataaaggtctgctggatatattgggaatccctacctctacggagaacgtattcgaggaggctccgcaagaggccgtgtccgtatatgctagcggtacgaaaggaagtttccatgtccgttgggcggaggtccccggttcgttcagcatccatgtacatgacgcttcgggccgtcatctgtatggtgagaaggtagattctccagcctcggtggattacgctgtttccttgggaaatgtccagcccggcgtttatttcatacggatagatacggcagagggtacggtggagcggaagatacgcatataacccggactcgtctggatcgtttatagctggtagcggatcgctaccagaaactcccggggacggatacgtacccatgaggtatagctttccaacgatgcgtatcgcgtgtatccgtaggtacgtttgtcgaacaggtttgtcgccgtggcggtgatttgcaaacgccgggatttccataagaccgagaagtccgcgaaaacggcgttgacggattggtcttcattcacgtcattgtgataatgatctacggaaaggcttgcctctatgggtgagaaaatgtaggagagttgtacttgttgggtgacgttccataagggcgccaaacgggtacgttctcctattttatttcctccgtaccggatatcggtttggtaactggtttcccaatggcggttgggagtccagatcactttgggctctaggcgcatgaggcgatattgataaggaagcctttgtcccccgctgatttgctcggccttgctgatattgaggagcgccatgagcgaggtctttagccctagatcgtaaaagcctttggatagcgtgcttttgacggtatagccggaaccgtggttggacagcggtaaggagactcgttgtacctgcccgttctctatacgttgctcgtatatacgattgtaccactcccggttgtgtgtcaggtttaccgtggcgaagaattcccgtgctgtactcttgtattccccataaacggaataaagctgttgtctgtaaaccgggaggattccgcaattccagacgctattccggtaatccgtttgataaggccggtcgtataagtcggtcatctctccatatctttccttataggaggcgtgtgccgtgaaacgccatgcgtaattcagtttgtagataatagacagggacggattaaccgagatgcgggagaaaccgacccctgtatatccggtccatctgagtggggagctgagggatagggtccatttataggtattccattggtaatcgggtgagagataagtttgcaggcttttcttgatattgctgatctccccgcttatgcccaccgtatatcgctgggtgagggaaccgctctttttcaggaatgaaaaggaattatcggtataaaagtcgcgtaagctcattggataaggatggttatccaagcgaagatcggccgcgttgctgtggtaacggagcaaagactggacttccaacgtgtatttgtccaagctccacaggctccgtaaattattacgtaagttgaggttcggggttttgatgcgttggtccaatgttgtacggccggtggaaattgtgtttccggttatatgggaaaggctggattgccaatctccggtggctgagaactggttcttgagatacctttcctgcgagttgttttccactccgatattgaggttggcttgatccgagcgaatgcggctatcgctttgctccgttagatgaatcgtgtcctcggattggtaataagtcgtctcactccccctttcctgtgttcgcaggtcgtggatataaccggcgtttatacggagttgggtgttctcgttcagtttatataggcgatttgcggataggctgtgtatatggttgaacagccagcgctctttctttagcggggcggagaatgagggttgtagcagaaattggggaaccttgggctcggataaacgggattcgggtgattcggtaagcgtattttgctcgcccgatacatcttgcccggtattattccctttatatagataagcggattggctgctgcggctgatctgcaaggcgtcagcggctcctttccataagaacggggatgcgccgagaccgccttcggcattgatcagccagcgatcccggaattccggtctcagtttgaggttcaacgctacgtcttcggtcttgatctttctctgtaacacacggatcggttggtggttctccatcacttgtatgttctgtacggcgtcggctcgcaggttctcgctgatttgcttgtatttcccgttggtgagatccagtccctccacatagaaattacggatctctttcccgttgtaagagatcttccccagatcatcgatatcgatacccggaagtttccgtaatacgtccttgatggattgatcctttggggatagaaagcgggtgacatcataattgatcgtatcttgctgcccccagacacgtcccggacggatttccacctcctttaggctgaatacctgcggctccatctcaaaacgaagcgtttgtccggcatgtacggcttgttgctgggtttggtaccctaagagcgagacggagacgagaagtgagtccgtccgcttcggttgggtgagggtaaaggtcccttcattattacttaacgtatagttgatcggaagggagacgttgcctctagttaattgcacggtggccgcttctaccggcagttggctttccctgtcgatcacgatccctcggatgacggattgggcggccaatcctgccgggcagagcagcgtaagtaaacaaaaagtgtgtatatgcagtatgatccgtttcatctttcttccctttctatagggttatacggcatgttcttgggttggtaaggtttcccgttatcgtcggtgacggtcactttcacctgtggcgaggtcaaggcgatgtatccgataggatcggcggcatatcgttcgtaaaccttttgcaggttcttgcggctgatcggctcgaaatcgtttcccccgaaaaggatcgggttcttatcccggctcagttcgatacccgtgcagatgaaagtgtaatgtccttggctgtcttgggcttttaggatcaggcccggtaatccgcataatttccaaggaccctcgcttttcggtatctccggcgtgtaccaagcctcataatgcctgcccttgaaatgacaggtcgctttccggcaaggataggacaggatggtcatcgtatcgggcagtaaggtccattccgggcgctcctccttttcctcgcagcgaaagcgactggcggcaagggcatccaaggtcgtggtctttcccgccggataattcttgtagacctgcgcgttggtcttggatgaatattgttgcaggtgttcattgatgacttcttgtgaggctccggcggctttgtcggcctctagtacggaatcggtgaggaatttggcgtaactatagtaaacggagcatttatccccgaccttcagcatgagggtctcttcctctttcttgtcgggttggagcgtgtccggcatggacgtggtctggtattgtaccgtgaaacgtgtctcgtcgatgggcttggctcttagtacgtcgtttaggttgaagatgttgattgtcacttgggcgttcgtctcgtgtcccgcccctgacagacctacgcaaagcaggccgattgtcgctatgattcgtttcatgatctgttggttttagaagttatttgtcgcgaatgtaagagaggaacgtttaccgtaaggaagatttttattactgaaatattactccgcttataaaaatggctacatgtacgttgtaatcatggagtagctatctatctttgccggaaaggaataagatatgggaaagaggattcgatggatatgggtaatctcgttggcggcggctttggcggcgatcggggtacaaggctattggttgttcaatcagttccggtatgagatgtgtacttatgcggatgagatcgccggtgaggtatttcatgccgggcaggaggaatttcgtatgcggaaggaagaggcggagatgacgaaaggtacttatattatagaacgccagtcgaaataccagtctggtgatagcgtgttaaacgggttgaaaaactcgttcggtttccagctttatcccaaggatacgacaaagatccatagttttcggcttcatctggacccgaatatgccggaagatagcttattagttggggtagatcgttcggtcgtggagttcttcgtgcctttctccgcggagcgtttggactccatcttgtctgccggtctgcccggtctggattatcgggtacgtccgttcgtagcgggcgataccttgtccgggcagtcgtcggccttatggttgccgttatcgaaaaaactgctttcaacctctatctcgatatgctatttgttcgccccgatcgagagaaaggcggtgtgggtggatgtggatcttcccatgaatccgttattgggccggatgggatggcagcttttcctaagtattttccttatcttgttattgctggcttgtttgggtttccagatccgtacgatctgggagcaaatgcgcttgaacgagttgcgtgaggggttcgtgcatacgatgatccatgagctgaggcgaccggtacaaaccttgaaggtattcgtctctttcttgaatgaccgggagatgcggatggatgaggccacgacggaacgggtccttcaagactccatgttcgagttggataatctttccgcctatctgggaaaattgaaagatatggtctgtgcggacgagcgggagacgcttctgagaccttccgcttttaatctccgtgagttggtggagaaggtggtacgcctaaccaatatccccaccgggaaaaaagtctctttctcgacggcctttcccccggatatgccggatctgacagccgatccggtacatgtggcgaatgtcttgtctaacttgatagagaacgctatcaaatattcgggagaggaagtgaatatcgatatcgtagtgctttggaatcagcaaggggtgggattgaccgtttcggataatggcttcggtatcgctccggatgagcggcgaaaggtattcgagaagttttaccgttcgtctcatctgccggataagcaaattccgggtattgggttgggattgagctacgttcgccaaatagtagaggcgcatcatggttcagtatccctgcgaagtgaattaggtgaaggcactcgaattactataaatctacctactgcagctttatgaaatcgacattgaaaatacttttcgctgacgatgactttaagtattccctcgtcttgaagcgattcttggaacgggaggggtatgaggtgacttataccggcaatggtaccatggctttgaagcaattcccggtcgtgaaaccggatctggtcttgctggatatcaacatgcccggcctaaacggtttcgaggtagcggaaaagatccgtgagcaagaccgccatgtcttgatctttttcctttccgaccgttccgataagaacgaccgtttgaaaggttttagcttgcgcggaaacgattacttggcgaaacccttctatccggaagagctgatcgcccgtatcaaggaccgttttgagatcggtgtccatgaaagcgtgcaggaggagagcttccatttcggaaacacgaccttcaactacaccacgaacgagatccgtacgggtaataacaaggtattgatcacttcccgccaagcggatattctgcgaatcctggcgacaaacctgaatctggcggtggatcgtgaccttctgttggaaaccgtctggggaactagctcatacgccaactccctggccttgaatgtgcaggtcacctatctccgtaaagcgcttcataacgatccgtctaccggcattgtatccttgccgaagaaaggatatatgctaagaggatagaatttatccggtagaattgggtttctgatccgtaagcattatctttgtcccacaaagtattcacagaaagaaaatgaatcatatatgaacttcagcgaacaatgtttccgcatttttgagcaagctacggaggcttatcatgtaactgacaatgtagatgctacagtgcataatccctatgcggtaaaaagcatcgagttttatctttatcttaagaactggatcgatgccgtacaatggcatttggaggacattatccggaatccggagatcgacccggtggaagcgctggctatcaaacgccgcatcgacaagtcgaatcaagatcgtacggatttggtagagttgatcgatagtttctttctggataaatacaagaacgtgaaagtcttgccggacgctacgatcaatacggaaagcccggcttgggcgatcgatcgtctctctatccttacgctaaagatctatcatatgcgtgaggaggcaaaccgtccggatgctactgccgagcataaggctcgttgtgagcagaaactggcggtgctgatggagcagaagaaggatttgtcgatggctttggatcaattgctatccgatatccgtgacggtaagaaatacatgaaggtctacaagcaaatgaagatgtacaacgacccggccttgaatcctgtgttgtacggtaagaaataatggcaaatatattagtaatacgactttcggctatcggggatgtggcgatgaccgttcccgttatctattccgcagccaaggcgaatcctacggactcgtttaccgtgttgacgcaagcgttcttgatcccggtttttatcaaccgcccgaagaacgtgaacgtgatcggtatcaatacgaagagcacggagaaaacgttggcgggattgcttcgttttgcctctgccttggtgaaatacgatttcgatatggtgctggatttgcacgatgtgttgcgaaccatgattatccgtacgctgttccgcttgaacggcagacgggtgtttgtcgtggataaggcccggaaagatcgtgcccggttgaccgacgcgaagcataaacgatttaaacaacttcgcccggtgatcgaacgttatgcggatgtgttccgtaacgctggacttcattatacggaatcgttcacctcgctttatgagacctcgacccctgatttatccgccttggaaccccttgcgggaacgaagacgggcaaatggatcggtatcgcccccttcgccaagcaccggggaaagatttatccgaccggggagatggagctggtcatggccgagctttccgatcgagaggattttaccatcttcctgttcggtggtcgtggctacgaggaggcgctcttggatcaatgggcttttgagtatccccgggtaaaaagcgtggcgggcaagtattccttggatcaggaactggccttgatcagccggttggatctgttgatttgcatggattccgccaatatgcatttcgcttccttggtcggtacacgggtgctttccgtttggggcgctacccatccctatgccggattttacggatatcatcaggatccggaagattgtatccagttggacttaccttgccgtccttgttccgtattcggccaaaagccctgcctgcggaaggattgggcgtgtatgagacagctcaatccggatctaatcataaacaaggtattaacctctttaaatgaaatggtttcggatgaaggaggtcattaacccggcgtacgggcgattcgaggattttgtaaggcgtgtacctcgtatattttcggaagagggaaaaacgatttataaggcgaggaatgagatcaaggtttttgaggtagatggtgtggaactgaatgtcaagcggtatagaatccccctcttgataaaccgtgttatttatcgttttttccgtcagcctaaggctgtgcgagcctatgagtacgctctgcgattggttgccaaggggtttgagactcctgccccgatcgcttatgtcctttttcgggagaaaggccttttgggatatagttattttatcagtttgcaatccagctataagacattgtataaagtcggacagcgtccggtagaggagaacgaggatattttccgtgcgttaggtacttatatggcaaagttgcatgaggcggaggtttatcatgccgatttctctcccggaaatgtattgtacgatcgtacggaggaaggggttaagttctccttgatcgatataaaccggatgcacttcgggcctgtctcgctgaaacgaggatgcgcgaatttctcccgtttgtggggacgggaagccgcttttcgtttaatggcagagacctatgccgagagccggcattttgataaagcggaatgccttcgttggatattatactatcgaaatcgtttctggaagaaatatgcgttgaagcatgagattgaatttgaattatagacttttatgaaaatacaaatactccggttctgtttagttgttagttgtcttttggcctatgtatctccggttaaggcgttagaatggtgggaaaaggtagagtatctgacttactcgccccgttatttcgggccaaatgcctttccgattcccgagttggtaggaggaagcctgtccagccgttgggaagtggagcttcggggggaatatcataagacgcgaggcgatcagacgaaagatatctttacccgtttgtacattcctgtcgtaaagggacgtgtaggagtgaatgtcagttgggtattccaagaatggtatgagatgtcgccggaagtgcgggatgagcgttatgcggtagaactgaaatccccgattgtttgccggggcgacgtgatctttaatttttatttccaagccctccggagcgagaaatggatggatatcgtggtaagcgccaacctgaaaaccgccagtggcggacgcttgtgcgacgctcgttatacggatgcggcctcttattggttcgacgccaatctgggacgtacgttgtggaagcggaaagatgtaaacgcttcgatccgtgtgcaagctttagcgggtttttattgttggatgactaacgatgtcgttaatcgtcagaacgacgctttctgttatggggcaggtgtgtcagggacctatcggggggtctcgttggattgtaattatgccggtttccggggatatcgggataatggggataagccgatgattctacggacaaagctaaattatgagcttaagaaaaatatcctgtccttccaatataaacatggaatgaaggaccatctttatgatagctattcattagcttatatccgttgtttctgaatctgtaaataatctatgctttcttgatcgacctgaataacgtggcgaagccgtctgtataagcctttacgctgaaatcttggatgatatgctcacgtgaggccttggcgaacgcttccaatcgctccgggttatcgataagcgagcggatagacgccgccatttgttgaggagaagaaggcggcactaacaatccggtgactccgtctatgattaagtctcttgctcccggtatgtctgttacgatacaaggtactgaacaagccatagcctctcgcacgactcttggggaggcatcccggtgcgagggaagtataaacaactgggacgtgaccagaaaagagatggcgtcggaacgctgtcccagaaaatgaatttgtgcgcttaccttcgactgttgggctaattggaaatcattttccccatattctcccacgattgtaagatgtacccgtggatcatccaataagataaacgcatcaatcaaatcggttaagcctttgaacggcctgttcttcgtcgctccgatatagatgcaacgaaaggcgtcgtccggaatatcgtctgcttgtttgggcgtacggactgcctccttgatccaatcgatatcaaatggctttgtgctggtcgttagtctttttcgtgcgatgaatcgggagagatattcctcgatatctttggtctcgcatacgacatgctccacggcgggatttaatatgcctagataataggtcggatcgaaccgcttcaatttagcctgcgtacctcggtatgcgatattcttcgcccgtgtgcctatggaagcgaatagagcgtttgataaaccggaactactcggtgagtagataaggtcgatccgataagtcttgatgattttgcgcagggcacgaataacgttccagttgaacttcgaggtaatgaccggcagatccaaaggtgtacaattcccatagatatttttgtcggtatacgattggggagaagcgatatagatgttgaagtcctcaagcttggacaatccttccagcattttgtaggttgctatatcggcttctttatagactaaaagtatattcattgtgtatggataaaatggatttgctaagatcgtgagatattctcgtatactcgcatgaaatgagccgctaatacgtcgggcatgaatcgccgtatattctctcgtccgccggaacgcatggattcggccagcttcggctcgttcaatacggactctatcaagccgcgcagttcttgttcgtttcttggatcggtatataaagcggacggtccgcccgcctcttccagacaagaaccggtagccgctatcaccggaataccggcaagctgggcttctaagatcgggataccgaatccttcgaaaaacgagggatagacaaataaggtcgccatctgatagaaagcggctaattcgttaaaaggtatatgagtcaagatatggacgcgaccggacaggttgttttcccggatataagtctctaccgtgtccgtataaggcgtatgcttaccgatagcgatcacggagatatcttctttcagctttttcagggcttttaccagaagcaataaatttttccgttcctcgatgctccctacatataatatataaggcccgtttatctgatatttctcgcgtacggacgatttcacgtcttcttgaaccgcttggccgaatatcgggtcacaaccttggtaaacaacctcgatcttgctttccggaatgtggaagaagtcccggatgtctcgcatcgtctgtcggctgatcgctatgatcttgtccgaccgtaaacaagcttgcttgaatttgtaggtatagatggaacgatcgatcggtttataaagctgcgggtaacgcaagaagatcaagtcatgtatcgttacgaccgctgggattccgttctgttttagattcataggaatctcattactcaagccatggaacagatctacgtgctcttttcgaagcgtagccgttaggcccgaggtacgccataaagacggaaatagtttatcgaacctgccttccggataatggaatgagacacttggacgctcctcgatccgtttccgtaacacttctttgcctttgcccggcgtatagagttgataggtatgctccgggaaagaagcggacaaactattcactatgaaccggctataattacccagtccggtagcgttatgcgtaatccgttttgcgtcgaaagcgatcttcataggcttgaattcgatatattgggcaaatatacgatataattttaattacctttacctcatttccttccgaaatccgccgggatctccccccatacggatgtttcccatttgaggatctgggtggtataggtatgggtgttcaaccatttctcggcccgctcgatgaggtcgaagataggttcgttgatcggtttacgtgctaatagggttttgcatttctttttcttgacccagctgatggcgttgcggctatccgaatagatcggcaggtcgcttcccttttgctgtagcaaggcgaggccgtgtactaaggcgaggaattccccgacattgttcgtgccctccttcagcgggccgatatggaagatctcttgcccggtagcggtataaacgcctctgtactccatatccccgggattaccgctacaggcggcgtctacggcaagactctcattgatggggttcccgatcggggcttctggcgcgagacgggccacggctttcggggaagaggcggtctttaggtaatgggtatagccggcctcgaaggctttggcggcttcctcccggttctcgaaggatttatatttggctccctcttgtccgtctacctgtgccttgcattccgcccagttatcatagattcccgggttcaaccctttccatacgacataaaacttattcttggccatgactcttactcaagatttcttgtgagaattgcgtataggtaccgaacggcgctcttttatccttgaagaaacggatcaaggcgtccagccttctttccatgccgcaaccggaatggttggtcatgataaacggcaactttagctctttccggtcgctcaaggaggtaaacttccacggatggaaataggtcaggaaataaccgtcctctttccaagtccaaagcgctaacttacggtacaaggtggccggaaggttatggtaagccagccaaaacaaggggaaacggacgatcggggtcaccgaggcgggcagttgcaatacgccatctttcatgaaataggtgcggggttgccccagatggttataacggccgggaatacaagtcgggttcaaggacgagttgtataagtaaccggccttatggatctcttcttcttcgacgggcatcatgcgggccatacggaaaccgttcaccggttgtccggtcagttcctccaatgcctctttggacttgcgtagatcggcggtctcgaacgacgagtgataaaaaccatgcgaagcgatctcatgtccacccttttggatgtccaagatcaaatccttcgcatgaagggcgaagttcgccgtgcaaaagaaagtcgcttttacccggtgacgggccagacatgccaatatcttccgggttccttccacggaagtacgcatttgttcctcgaacggcaattccacgccgtgttccaatggagcgtcaaactcctcgatatcaaaactaagtaatatcatgaatgttaattaatctctatgaaataagatggataagaagttcaacgcttcccgccgcaggaccttgaatcccatatcggataccgctagtccttctttgatgttcgcattgatcgtccgtaagtttatctctttccggcgacttgccttatagataaattctgtatcgaacaggaagctattgatacgggtggtcaggaatatcgcttgtcccgcttgactgaatcctttcatacctccttgcgtatccttgatcttgatcctcaaaatccatgtgttacatatatgggatagcttggatagcacttttcggaaaggaggcaaattctcctgataacttttgctacgggtagccacgaccacgtccgctcctcctagcaacgtctcgaccatcctgccgaacgagtcgtttgtataagggaaatcgtagtccgtataaataatgtagggagaggtacatcgctttactgcctctcgcaaggcatatccttttcccctgttgggcttatagtctacgacgcagacattcggtatcaattgccggaggcggtcaatcgtttccggctcgtatccccgtctcgaaccatcactgacaataaaaaggtggaaacgtaccgggctgaataatcgctccacttcgcggaaatgggtggctactcgttcctcccagcccgaaggcgggttgtaacaaggtaataccaaatctatgtctgctcgtgcgttcattccatttatacctttaccggattataactcctcgtacacatctcaaatgtcagctttagccagatcagcatacaaggcaacgcttttaacgcatacgggtatacataatgcactcgtatgtatttcgggaaaagatcggacggagacatgctggtcaatataaaggcgaagaccatcaagacaatatccaatgtcgaacgtttccacggtacagccgtataccaaatagcgactccgataaacgctatgatataggtactggactcgctacccgtgctgaacagtacgacaaacatcgacaccgaggccaataacgttttccggaaagcctcatatttatattgactgatgcgtagataaggcaggccgaatactattaatccccctattatcagataaatgtccgagtaactgaccgatcccgatatcttacgaaccattcccaagaaggaaatgttctgcatgagcgcaaataagttctccgaattttttccggataagtcctcgaaccaaccggtatattgggacattatataatccggcccggacaatatcatcggggctacgaccatgatgaccgcccatcctacgcaagataggctaaacttcatcttatggcgagagaaaaagaagaatgccaatcccgtgatcccatacaatttagtaaaggtacccaacatgatcacgaaagcggcccatacgtctttctctttctctatcaatgcgtaggcgaggacaatgatagcggcgatactgatattaaattgcgacatgaaaagcgaggtaagcaactcgtgggcacagaaccaatagataaagatacgttcccgcttgatccccggcagcatcttgaccgcccagaataagaaaaggctttgcgccaccgaccaagtgagcagtcctaaccataacggtgtaatggcgaacggagccactaccaagctaaataccggcccgtagtgaaaaatgtcgttgtattcttccggataggcggcatagagcggcaattcattcaacgtatgccaaaaggattgtctgaagatcgagaagttgttatatttcccggggaaatacttggtaatccatgcgataacccccagcaatgtccatagccccatcaaggtactatatttgctgaagaatggtttatggatgatcgtattgaatttatctataaatttcatcatcgaatctctatctgtctacggggcaaaattacataaaaacggtgacttttatgcgagttaaataaaaatactatttttgcgtccaaaactggtaagagattatttatgaatgaaatgttgagatacacgatcattcgtgtcattctgtttgtaatgggaggctttcttgttctcggatgttcggatgaagatgatgtggataatagtggaggaacgagtaaatatggtttaatacggatggcggaggaggattatgattcgtcgaatacttcttatatccttcgggatgaggaaccggacgaggttcttttcgattcgtcaaagcgaaaattcaaggtgaatgagcctttgcaggtgtcagttaccgggcagaaggagttgatgcttcgtttctattctcctagagctatccataatgtgattgtctgggctacggttgagggttgtgaggatgaggtacggtttgcggagtttactacggttttaccttttcaggagtttaaaatgaagctgccttttctagaacgggcgaaggtttattatacacgttccggcgaggaggttaccatagatgcccatccggatatcgtggccgagaatataagtttgcgggttgaatgtggagatccggtctatcaaggaatgataaacgtgaaacctaagtgggatatttggtttggtaaatattctggttcgaactggggcaacttcaggccacatctggctcgtgaggcggttgccctttccttgaatatggccgcgatgttttcttcctcgctttttgatgaggaactggagaagtggcgcggcaagctgataaataacgagcaaatcgtggatatagatgtgttgaagaaacagatcacgaatcatggcgggttgtgttatggacgcgtggtgaatgttgtcggtctgggtggaggaaatacctttgggctaggtgaatatgtctatctgacccattatgccgacgatgccaatggttctgacacgccgtatcatgagctggcgcactgcttggggtatgggcatagtgggaatatgacgtactatccggcggaaggcggtttccctacaatttgtatgaaggtttactcacagctttccgtgagcaagaaattaccggtttattcccgccgtttcttgcatacccggaggaataagaatctggtagagaataaaaacgtgtatacttcctcgaaatacattatcgatgatccggaattggatgccatagatggcgggcttgggcttgctccgatggagacggatagggctggtgatgagggttctcctctctcatttacactttctgtcttggatattcccggtgccactgtggaaacttttcatccgaaagcggtccatctttatgggaatacgctatatgtagcaaatgacgctccgggacattatagtttggaggtctttgatgtatcttccggtaatgtgcgtcatgtgaaaagtatggttgagtggatgaacggagataagaaagagacctttgcgggggagccaaacggcgtgactcgctcgtatgggaaaatatatgtcacgaatacgggaagccgtacggatgtgtttgatgcggaaacgtatgagttcattacttgtatcggtacgggtacttggggtgagggtggttatcagaccgttcatgcgtttgatgtgacggctagtcaaggggctgtctttatccgggataaacggaaactggtagttgtcttggagcaagatgtacagcccggttccgctgctcgggtacctatatatagccgtagcgtaaatttacaagaggcaatgggtacttatgcagtagcggcacgaaatgatggctttttatatgtgacggcccagaataaaaatataatctatttattcgatcctgcggacattcgggcaggggacacgggctttgcgccgtatctggtgacattgggatttgaaaagtctccccagtcgatagcgtttgtaggggatcgtttgtttgttacgcttcgtgtcgatgataaacggtcggagctatgggagatcagccctaagaacggaaaattattgcaggactttactgattcgatggtctatcccgagaaaatagccggtgctcgtcatactttattggtagtggatcgtgcgacccagacagtaaaagccattggcctatgatttttttattgattcttaggaataaagaagatggagttcccggaaaaagtttacatttgcgaaaactattataataacgtatgaaacgtgtttttttggtcggatatatgggagcgggcaagacaacggtgggaaaagagcttgccaagctcgccggtctttcgttcatagatcttgattactatatcgaagggcgttatcataaggccgtttcgcagatattcgccgagagaggggaggaggctttccgagagatagaacggaatatgcttcacgaggtcgctgagtttgaggacgtgctgatctccacgggaggaggcgctccttgctttttcgataacatggagtttatgaacgcttctggcacgacggtttacttgaaggtgtcagtcgaggagctggcgaagcgtctggagttgtgcaaacatacccgtccggtgttgaaaggacgttccggggaggaactgaaggcgtttatcgccgagagtctggagaaaaggaatccgttttatacgaaggcgtccataacgtttgatgccgagaagatgttaacagaatctgatgtacatgacatatcgaacgcgttaatgaaaatcctatagcatatggaagcgaacgacggccggcaggcacagggggcctatatcccgcaggaattattgaaagagatcagcaaggtgaataaccgtttgctcatcggtattcctcgtgaacgatgcgaggcggaaaaacgtttgccgttaactccggaggcggtggatatgctgaccgattgcggtcaccgggtgctggtggaaagtggcgccggattaggtatcaactattccgataatcatttctcggaggcgggggcggagatcgtcgatacgcccgcagaagttttccaagcggatctgatcttgaagatattgcctccgttgccggtggaaatcgcacttatgagacctcgcacgaccgttttctcattggtgcagtttaatttattcgctcaagaggctttcgagttgatgatggcgaaacggattaccgctatctcttatgagttgatggcggatgaatataatcgtttcccggtgctgaatgtcacttccgagatcgagggggcggcttccataacgatcgcttccgagctgttgagcaatacccaaggaggtaaagggatcttattaggcggtatcccgggcgtatcccctacagaagtggtgattatcggggccggaaacgccgggaccgtggccgcgcgtgccgcgttggccttgggagcatccgtgaaagtattcgatgatgatatcaataaattgcgtataatacaacaggtcttggggcaagggctttttacttccacgttccatccgaatgtgctgcataatgcgtttcgtagcgctgacgtggtgatcggggcgatgcgttatattaatacgagacatcgctatattatcgctacggacttggtgcgtacgatgaaaaagggagctttggtgatcgatctgagggtaagccaaggcggttgctttgagacgacttgctgcttgtcgagggaagatcctgcggtgttcgagcaatatggggtattacattattgtaaactgaatatcagcaaccgggtggctcgtactacctcgatggcttatagtaatatattcgtacctttattattgtcgttgggcgacgccggttccgtgcaaggaatgatcaaatcggataagggctttagggcgggagtatatatgtattatgggaagacagtgaatagttatgtgtctaaccattttaatctatcatctaataatcttgatctatacctctctgctttttgatgcggaaaagttttgaactcgcaaagtttatgctttactttgcggacgatctaaataccaataagcgataaagctaataaagtatattatggcagaacagacaaaagttaagacgctggagaaggttgtaattcgtttctcgggagactcgggagatggtatgcagttaaccggtacaatcttttcaaacctgtccgcggttttcgggaacgagatttctacattcccagactatccggcagaagtacgtgctccacaaggaacactaagtggtgtatctggattccaagtgcacttgggatcgcgcaagatcttcacacccggtgataaggccgacgtattggtggccatgaatcccgccgcgctgaaggtgaacgtaaaacacctaaaacccaatgcgattgttttaatcgacacggactctttcaagaaaagtgatttggataaggccttgtttacgaccgatgatccgtttactgagctgggattgactggcgtgcaggttgttgccgctccgatctctacgatggtaaaagacggattggttgagtttggtttggacaataaatcggctcttcgctgtaagaatatgttcgccttaggacttgtttgctggttgttcgagcgtccactggaggaggctatgcacatgttgcagaataagttcgctaagaaaccggttatcgcccaagctaatatcaaggctttgacggacggttataattatggtaataacatccatgcctcagtttctacgtatcgtatcgagagtaagaaagccgagcctggattctatacggacgtgaatggtaataaggctacttcctatggtttgatagccgctgccgagaaggctggtttgcagttgttcttgggtagttacccgatcactccggctactgatattttacatgaattatctaaacgtaaggatttaggcgttatcacggttcaggccgaggatgagatcgccggtatctgtacttctatcggagctagtttcgccggttgcttggcggctacatctacttccggaccggggcttgccttgaagagcgaggcgatcggtttggctgtaatcgccgagttgcctttggtgattatcgatgttcagcgtggcggtccttctacgggcttgccgacgaagagcgagcaaacggacttgatgcaggctctgtatggccgtaatggtgagagccctgccgtggtaatagcggcctctacgccgactgattgttttgatgccgcattttgggcgggtaagttggccgtggagcatatgactccggttatcttgttgaccgatgcctttatcgctaacggttcttccgcttggagaattccggaaatggataaatatccggagattaagccgaattacgtagctaattatcaagacgagaaagtctggaaggcgtatcgtcgtaacaaggaaagcttggttcgttactgggcgattccgggaacggaaggtttcgctcatcgtctgggcggtctggagaaagactacgagacgagtgcgatctctaccgatccggctaaccaccagaagatggtgacgacccgtcaggctaagatcgataagatcgccgactatatccccgaactggaagtgatcggagatgaggacgctgatttattgattgttggttggggtggaacctacggacacctttacgagacgatggagacgatgcaagagaatggcaagaaggtggctttcgctcacttcaagtttatcaacccgctgcctaagaatacggctgaggttctttctaagtataagaaagtggtggtggctgagcaaaataacggccagttcgctaactatttacgtggaaaggtacccggatttaacccgtatcgcttcaatcgtgtaaagggacaaccttttgtcgttgcgagattagttgaggaattcactaaaatattggaggtttaaaagatgacaacagaagaaactaaatttcaaccgaaagattataaaagcgaccagtacgtacgttggtgcccgggttgtggcgaccatgcggtactgaattgcctgcataaggctatggccgaggtaggagtggctcctcacaatatggcagttatctcaggtatcggctgttcttcccgcttaccttattatatgaatacgtatggcttccatacgatccatggtcgtggagcggctatcgctaccggcgtaaagacggctcgcccggacttgagcgtatggttgattacgggtgatggcgactgcttggctatcggcggtaatcattttatccacgctgtccgtcgtaatatcgatttgaatatcgttcttttcaacaataagatctatggtttgacgaagggacagtactccccgacatccgaccgtggtttcgtatccaagagttctccttatgggacggtggaagatccgtttatcccggccgagttggcgttgggtgcccgtggtaatttcttcgcccgtacgattgacgtggatttgaagaatacgaccgaggtattgacggcttccgcccgtcataaaggcgcttccgttacggaggtattagtgaattgtgtgatctttaatgacggtatccataaaggtatcgtagacaaggaataccgtgcggatcgtacgattttccttcgccatggcgagaaaatggtttatggcgctaacatggataaaggtcttgtgctagatggcctaaaactgaaatccgtaacgatcggacaagatggttatacgatggatgacgtattggtacacgacgcccatgagaaggataacaccttgcatatgatgcttgccatgatgagcggtgatatgccaattgcgttaggcgtaatacgagatgtggagggaccgacctatgatgaggctgtccaccagcaaatcgaggaggtacaagcgaagaatcctacacgtaaattacacgaccttttgatgaaaggtgagatttgggaggtaaagtaatatatttctgattggatataagagaaggcgcaagatatttatcctgcgcctttcttatatttatacgctggatttgtttgtgcggaaaaaagtatatatctttgtttcagtcacaataaaagcgaatacctatgatgacaacttcggaaatagttgagatgctagctaaaagtatatgatttgtaaactccatattacaaatagactaagggttttgttaattgcatggaaaagagtaattattactgaaaaatttccttaataagctgtgtacgataaaaaaaaatattacttttgtaccgcggttaacaaggtggagtcgcagcaagctccaaaaggtcggaaagcctcaccgtatcgaactagagtagagagaaaagttatataaagtcaatcatttaaattaaattcaagatggctaatttagatttaagcaagtacggaattgttgatgtgaaagaaatcgttcacaatccgtcttatgatgttctgttcgcagaagaaactaaaccgagtttggaaggcttcgagaaaggccaagtaactgagctaggtgctgtaaacgtgatgactggtatttatacaggtcgttctcctaaagataaatttttcgtaaagaatgaagccagcgaagattctgtatggtggacttctgatgaatataagaatgataacaagccttgttctgaggccgcttgggcagacttgaaggctaaagccgtaaaagaattgtctggcaaacgtttgttcgttgtcgatacattctgtggcgctaacgaggctactcgtttgaaagtacgtttcatcatggaggttgcttggcaagctcacttcgtaactaatatgttcatccgtccgacagctgaggaattggctaactacggcgaacctgatttcgtttctttcaacgctgctaaggctaaagttgacaactacaaagaattaggcttgaactctgagactgctactgttttcaacttgaagactaaagagcaagttatcttgaatacttggtacggtggtgagatgaagaagggtatcttctctatcatgaactacttgaacccgttgcgtggtatcgcttctatgcactgctccgctaacacggataaagagggcaagagctcagctatcttcttcggtttgtctggtactggtaagactactttgtctacggacccgaaacgtttgttgatcggtgacgatgagcacggatgggataacgaaggtgtattcaactacgagggtggttgctacgctaaggttatcaacttggataaagagagcgagccggatatctacaacgctatcaaacgtgacgctcttcttgagaacgtaacagttgccgctgatggtaagatcgatttcgctgataagtcagttacagagaacactcgtgtttcttatccgatctatcacatcgagaacatcgttaagccggtttctaaaggcccgcacgcaaaacaagttatcttcttgtctgctgacgcatttggtgtattgcctccagtatctatcttgactccggagcaaactcaatactacttcttgtctggatttaccgctaaattagcaggtacagagcgtggtatcacggaaccgactcctacattctccgcttgtttcggtgctgctttcttgtcattgcacccgacaaaatacggcgaagagttggttaagaagatggaaatgactggcgctaaggcttacttggtgaacacaggttggaacggtagcggcaaacgtatctctatcaaagatacaagaggtatcatcgacgctatccttgatggttctatcaatgaggctccgacaaagaagatcccgtatttcgacttcgaggttccgactgcattaccgggcgtagatccgaagatcttagatcctcgcgatacctatgctgatcctgctcaatgggatgagaaagcgaaggatttggctgctcgcttccagaagaactttgctaagttcacgggcaacgaagctggtaaggcattggttgctgctggtcctcagttataattgcttaaaaaaccttgatcaaaaaaggtcaaggtttaaaaatatctttataaaaaagcgtggaattactaattctgcgctttttttatgataactacgttaattttattataaatgtaaagtagttaaaaaaaatattcctacctttagaccggattatctgttataagaagagcttaaaaaggagtaatgataaaaaaactggcacttattattggctttataatttgtttgtcatcttgtggcaaggattatgtctatcggattgaaggggaactttctaatctggaaggtcaaaccgtatatgctgtatttgagaaggataattataaagtggttgataccgtggcttgtacgaaacccgggcagttccagatcgatcaaaatgaagcgggtttccattgtgtgactattttctttgcagataaagagcattgggttacggcttatctggaaccgggagaaaccgtaaaaatcacgggcgacgctaactctccattgctattgcaggtaaaggggggacggacaaatgataagttgaccgcttttaagaaaaaaatcgctcctttattgacggaattgacaaatttatcaaattctttaaatagcaaggatttgaacgatacgatcgaggagacggatatcgccgctcgtttggcgaatgttaatatgcaattgagcgaggaagcgatccggtacgtgaaagagaacccggatgaagaggcatccgttgtcttgattcaatcttttttctcagatcccgatgatactcgtaaaattgatgagttgttggcgttattgaatccaaggttgaaagacttttatctggtgaaggagctggagcaatatagcgcccgtgcgaaacgtacggctttgggtgcggaagccccagatttctccgtaaggaatatttatgggaatacggtaagtttggattctttcccgcagaaatatttattgctgacgtttaccgctccttggtgtgatatgtgccagacagaggatctatatctggataaggtagcgatgaaatatccgaaagatcagttggacattcttttggttagcttggacgataatccggataatgtccgggatgtactgaagaaggatagtatagcgtggaacttggtaacagattcggccggacaagcggctatgttgatagatctgtataacgtaagcgtattgccacgctgtttcttgatagatgaggatcataagatcttgatgaaaacagagaatggaatcgagatcaagcaaacactggaaaacttgttcgaagactgagcgattgaaaacaggaggttccggttttaatttgtaattagtaactcaaaattcttaactatgttagtaaaatcttatgccgctgccgtgcaggggatttccgctacggtcgttaccgtagaagtgaactgttccaaaggtatccaattctttttagtcggtcttccggacgtggccgttcgtgagagccatgaacgcattatctcggctcttcaagtatgtggttataaattcccccgcaatcgtatcgttattaatatggcccccgcagatatccgtaaggaagggtcttcttatgatctgcctttggcgatcggtattctggcggcggcagagcagatagattcatccaacttatccaaattcgtattgatgggcgagctttctatggatgggagcctccaaccgataaaaggggcattgcctatcgctattaaggctagggaagaaggctttaagggctttatcttacccaagcaaaacgcttgtgaggctgcggtggtgaacgatctggaagtgtatggagcttcgaatatcaaagaggtgctggagtttatggaggggaaacctacattgcggcctacggtcattgatacccgtaaggagttttacgaccgccagcaattgtttgattgcgatttctccgatgtccggggacaagagaacgtgaagcgtgcgatggaggtggccgcagccggcggacataatctgatcatggtaggtcctcccggaagtggcaagtccatgttggcgaaacgtctccctacgatcttgcctccctttaccttgcatgagtccttggaaacaactaaaatccattccgtagccggtaagataggaggtggcacctccttgatggtacaacgtccttttcgctctccccatcatacgatctctaatgtcgctatggtaggaggtggcactttcccgcagccgggagagatcagcttggctcacaatggtgtcctttttttggatgagttgccggaatttaacaggagtgtcttggaagtcatgcggcagccattggaagatcgagtgatcaatatctcccgtgcccgtttcacggtggaatatccagctggctttatgcttgtggcctccatgaatccttgtccctgcggctactacaaccatccggaccgtccttgtctctgttctcccggagccgtccagaaatatatgaaccgcatttccggcccattactcgatcgtatcgatatccagatagagattgtccctgtccctttcgagaagatttccgagcaacagccctcagagcctagtatcgctatccgtgagcgggtcataaaagcccgtgcgatccaggaaaggcgttttgccgcttatgagggtatttattgtaatgcccagatgaactccaagctactccatcagtacgccgttcccgacgcttccggcctctccatcctcaaaaccgccatgcaacgtctctgcctctccgcccgtgcctatgaccgtatcctgaaagtctcccgcacgatagccgacttggataattcggaacatatcgaagtccggcatttggcggaggcgatacagtataggagtttggatagggagaattgggggatgtgagattgcacttagaatacatctattaaccataatagtgcagttactaagctgaaaaaactatctttatattagttggaaattgcgctatttatggctgttgaagtgaataactgacggcttgtcgagtgaacaactgatggctatacctggtggtcagcttacggcttgggaagtgaataactaatcacttgggaagccttttgtgaatgatttaacgtgctgtatgccagtcaagaaaagatatccgagcagaaggtctttaaaagtaagctagcttacttttttagggttgtttaggaattgcggtattcttgcggactcatacctacatggcgtttaaaatactttccgaagaaggacatattagtgaaattcagtgtataggcgatatcgtggatggtaaggttcgtcgattttagttgtgcctttgcgtccatgataaccatcgaggtgataatctctatacaagtttttcccgtactttgtttgacgatcgtacttaggtgtgcttgcgtgatgccaagccgcttggcataccatgcaacggatcgttgcatggtatagttttgcattactagttgagtgaaattcttactgattagctctgctttggagagcattgacaggtcttccgtctggtctttatacatgctgctgatccccatcagcataccggtaaacaaatggttggtaatcccgcgatttattttcgtggcgtaaaactcgtatgttttgagtaataactcaaaataatctttcataagaggctgggctttctcttttagcttatacaccggattgtctttcacgatataatgcatgtctatgacagctttgctggagttcgcttggctgaggaaatcagatgagaatcccatgaaatagatctgtaggtccccgtctgccctatggatctgcaggattgatccgggcatgatggtgatgaagcttccgggttctaccttgagttgcgttaagttgatggatgcctcgatctctcctcctaggcatagcacgaaaatccccgctttcaatcggcatgggtaattcgcatacagattcagcaggcctatatcttcgatcgaaagcttcccgatcacccaatcttgaggcaggtctattttgggaatgtcattttccatgtttgtttaattattcacttatcgggaacgtttgacaaaagtaggcatttttaaagatttgccgtgtcttgtggaaggaaaattatacgagcgtctgaaacttgcggtattccggaggcttttcggagtcgcttgggtgtttgggctggactggtatggtttcttgtcgaaggaagtagttgccattagaattatcttttctgtttcgttttgattgaatttggatgtatattgtgacaggggtatttccttgacctatcaaaatagcgaaagaatcaggaagataagtggccttttatgttaaaaagtaacgttttcggtacacgttagacggcgaatatgtatgcaataggcagcattgggcaatgcctatactgccgttgggcatcgtgagtagtcgtgaataggggtgtaagtagtcgtgaataggcattcttatactgttataaccctattgtaagactgttttttccctctctcactccccataatatgaattacgatgaattatttttgctagaacaaaatgtcgttttttgatatatggctatcattcaaataattgctgattttctcttatgaatttggaagtaagtagtactttgccccgaaataatcgatactcaagaggttgagattacaaattgccattttgtcaaatccttttttcttccatcgaagcgactatcttgtaatcttgctttctctaggggcggctcttgtctgagcgcattttgtttaggcacggtttctaataaaaggaacaatgggttgtaaaaatagaacatggccactctttataaatggctctgtatgtgtaggggtgaggtatggaatctaaaaaaaggaataggtaataagacaaatagaccttgtaggatctttgtgaaatatattcttttgcatccaaattgggatcgaatggatctatacgaattgaagtaattgaaaaaagcatttatatgaggaaaaagaattttacatctatgggaatggcctgcttactgggctgttgtttgatgttgggtagctgtagctctgaagtggataatttggatattccgaagggcaaaggtttcgtgaaaatagatctggcaccggaggtcggttttcaaacaaaagccgtggatgagagtgagtataaggatgtgaacaattatactgtgcaagtgtttaaatccgggcaagaggagaatcttattattaatgatttgtataagaatttggaagagaaatattctttgaatgttggtaactatgtgttgaaagcctttacgggtgaagataaaccggtttcttccgatgtgttgtatttttctggcgaagctgcttttgaagtgaaggagggaaaggaggtgacagctcctgtaatatgtaagcccagctcagctcgaattaatgttgtgttcgatccgaagatggatgagtatttctccgactattccttgaagattgagacagaggcgcagaaaccctcttcttttgtttgggcaaaggcgacagtcggtccgatgtattttaaggtaggtaatcaggaaaaggtccaggttacggtaagcttgactaagaaagagaatgtaaaagcagaagggacggttaagacctatacgttaagtccagcggatgctttgaaacttactttgaaaccagtagtcaacaatggcaatttaggaatttcgattacaattgaggagactacggttgatcatccggtagatatcgttattccgggggattgggtataaatatatataacagtaataataagagattagaatatgaaagcgatcaatatatggatgttgagcacggttttgttttccggcttgatgtcgtgtgagatgaaagaggagattttcgggaaagagatcccaaaggaaactggctatttgacacttgacgtgagcgcaggttcctctgcttctttagcaacgaaaggagcaactgatcagaaagaagattttccgctcgtgatcaaggcgatggattttgatcttactaaaaactatgagtcgtttgctaagtttaaagaagaaaatgcgaatggtgtgattgagttgccgaaaggaaattatgagatagaggcgcattcgccgggagagtttgccgaaaagatgtacgatccttattatggaggtgtagaaaaagcagagataatgcctagtgtggaaaaaaccgctacggtgaaatgtaagatccagaatgtcaaaattgcgatggattttacctccgagtttataaactattatagcaaatggtctattacggtggatgacaagtgcggtcattcagatatttatacgcaagaaaatccaaacccaactccgatttattggaaaatggctgctgagacagataagatttatgtgtcgggaacagctatagtgaaggaaacgagtgaagaagttattataaatcagacattaacgaagaaggaaagtgctgattttgtagaaagcgacagcccctattttgtaggaggagatggtttggcgatctcgttggctcccggaaaagaagtggatctcaataaaaccggtatcaccatcacggttaacggttttaaccaagagacaaatgagaatattgatatagaagtggaaggtgatagtggcgaagagaatcctgaacctccgacaccaccggtgacgggtgatgatccgacaatcacgataccgcaagctctttatacgttgcccgctgatgaacaaaaaaatgcaaatgttattatatcaactcctgccggcttgaaaaatatcactgtcgcgataaagggaggaaatgagctttttgcgtcaatagttaaagatctatttggtgaagagtttaaattgataggaaatgaagctttaggagagacgttgacgtcaatgggtgtaactttacctgttggtggagaaaagagctatgaatttccggtacatgccttttttagtttgttgctagatccaagtactggtggaggtgttacaacagatccagaaggacacgtatttaatattacggtggaagataatgatggtaaagtcgtaaaagataaattaagtgtaaaagtggctgaataatatgaagacaatatatacacttttattttttgtgttggtattaggtttggtcgcttgccaggccgaggatgatacatccatgaaaaataccggttatttaagtatggatataacgaccaataattccacagccaccaaagcgggaagtgaggaggttgtttataatcccaaacagttggcggtacaaatcttgaatgatcaaggaggtgttgttaaggaaacggatgactatacggcgtgggatggagagcgattttccttgcctacgggtaaatacgtggtgaaagcctcttcaaatggcttcgatggtaaagctgccgagtttgataagccctattatgtgggatcagctgaggtagaggttatggcaggaaaggatgtgacggccgaagttatctgtacattggcgaatgtcttggtgactgttgaatttgacgagctgttcaagaaaagctttaagtctgcgaccattgttgtggctgattcggcagaccaaactggaacccgccttacctttgagttaggtaagaacgagacagcaaaggcctatttcccagttcccgagaagtcgttgattatctcaacgagcgtaacgaatcaaaagggtacactacattctaagaaagataccgttcgtgcggtaaaagctcgagataatgttcgcttgatgtataaagtggctgactcgccaaatggttctaccagtattgatattactttggacggaacaatcaagacctataatttcaccataggtgtgcctctgaccgctaagacaactctatcggcaagtgcggcgaacgcttggagttcatttgcttacttggaggggaaggtgctttcaaaggcaggtgtcttggatcaaagcaagttggcgatggaatataaactggcaacagacgaggcttggactccggttgcgtatctgaccgtaggtgaaaacgatacctattcggtaaggattacgggcttgactcctgcaacaaaatatcaataccgttttatctataaggatacggaagaggtggcaagcgaaatcgtagagtttactacggaggcggctatcgcattatataatgctaattttgatttatggtatcagaatggaaagacatggtatgctggggaatccggtaaatcattctgggatacgagtaacccgggtacgacaacggggttgggagccatagtgaatatcaatcctacccaaggtagttcagcggttgtgcatacatcgggcggaaaatctgcggagttgaaatcccagtttaaggtgaaattcgcagcggcgagcctgtataccggatcttttggtgggctggttggtatgaatggtgctaagatcaattttggtcagccgttcgcttctcgtccaacagcattaaagggctggttccaatacgctccggtaaatgtaactcatgtaggggataatcttccggctgacgcagttgttgaaaaaggagatcctgatgtttgttctatttatatagcgatgtctaaaaagcaatatactatagataataccaaaatggcagaaactgcgatcgattttgagaatgatgcgaacattatcgcctatggtgaggtgcctgtgtcggaatgcgtaagtaccaacggacaatggaaggagttcaatatcctcttgaaatataagaatctgacggagaaaccgacccatatcattgtggtctgctcgtccagcaagtatggcgactatttcaccggaggcgatggcagcataatgtatctcgatgatttttcactcatttacgatgacgagcctacaatgtggaaataaaccataggctgaaagtctatgtagggaacaataagtttttactataaatctatttggcaagtaaggatatcttccttgctaagtagattttaaatatctttgtggcaatataaaggatagaactagaaaatggcaataacaatagagcgaattatttgaatgagtagaaaactatttaccttattgctgttattagcaatagtgaccggtaccgtaaatgcacaacgcggtaaacgcaccatcaagcgcatcgaccgagaggtacaggaggctgtgttcatcccgaaaggaacatggatggccggaggtgccgtatcgtattccgagcatgacgagagtaacttgaactttcttgttataaaggatttggaagggaatggctataattttgcgataagtccgtacgtgggctatttcttccgggataatatctcggccggtgttcgcttcgcttaccgtaggaactatttggatctagggaatgtggatgccaatttgggcgacattaccatctcgttcaaggacctctattatctggagcataaatatgagacatccggtttcctgcgcacctatatcccgatagggaagagcaagatattcggtctcttcaacgaggctcgtgtgacctatggctacggtacgggcaagaattccacaggctcgggggttaattatgatggtacttaccagaaggtacagaacctacagattggtttcgcccccggactggctgcctttatcaccgattggagcgccgtggaggtgtcggtcggtgtgatgggtttcgatttcaagtggatcgatcagacaaccaaccaagtggagcagggttcgagccgtacatcgtccggtaatttcaagatcaatcttttttccattaacataggtatgactttctatttgtaattggatatgcgaataatcaatgatatatataaagtgacctgtcgcttttgcctttttgttttcttcgtgctggtttcctgtgcgatagagaatgatataccctatccgatcgtcaatgcgggtatcacggacattcgtgtggagggacagcgtccggctgaaggctcttcggatgatgcggcattaattgatgcttcggcaaagaccatattactgtatgtaaacgattctgctgatatttctagattgaaacttactcgtttggtggtgaatccaaggaatgcgcaggttttggttgattcgactctctgtgctaatcctaataaattcccgtttgccggattcgcctcattggatagtattcctatgtcatccaatacgagggtcgattttaccaaaccggtcaattttactataaaaacctatcaagattatgtatggcaagtaaaggtgaagcaaatcatagaccggaaggtcgaggccaagggtatgatagactattctattgacgaactggataatcgagtgattatttatgtagggaaaggagagaatctgaagaatatctctataacctctttggctttgggtggagcctatggcgaggtgacgccaaatcctactaccgtgaaagatttcacctctccacagaagtttttggttcagtatccctggagcgagcccaataaggggacaatatggacggtatatgtccgcctgaccgatgaggagggaggctcgcagccttcagccggagatctttccgtgaatacatggagcaagtatgcgtttgtggaggggaaagcaacggaggctaattgttcgtttgagtatgtgaaacagggagagacttcttggaacatggtttccgcgaaggcaaacggttcgaaggtttctgcgaagatcgagggattgcagcccgccacggcttatcaatgccgactggtggatgcctcgggaagcgtgttgggcgagtctaccttcacgacagagactgccacaccattatataatggtaatttcgatctgtggcatcaagatgggaaaacatggtatgccggtgaggcgggtcattcattttgggatacgagcaatccgggtacgacaactggattgggggctgtggtcaatatcaacccgactcaaggaaattcaacggttgtgcatacgccgggtggaaaatctgccgagttgaaatcgcagtttaaggtgaaatttgccgctgcgagcctgtataccggatcttttggcagtttggttggaatgaatggtgcgaagatcaaattcggaaggtcgttcgcttcgcgcccgttcgcattgcatggctttttccaatacgctccggttgcggtaactcatataggagataatcagcctgcggggacgctttcaaaaggagatatggatgtttgctctatctatatcgccttggctaaaaagcaatatacggtagataataccgatactgatacctttattgatttcaagggggataataatatcattgcttatggagaggttcctgtaaaggaatgtgtatctacgaatggggcatggaaggagtttaccattaatctagagtataagacgcaggaaaagcccggcgatatgcaccttatcatcgtggcaagtgccagcaagtatggcgattattttaccgggggagacggtagtgtgttatatgtagatgatttcgaacttatatacgactaaataatatgatgaagcagattgataaattttgttgttgtatattctcattatttctcatgatggcctgtcaggaggaagaaataatggataaaaccgccggctttcaggtatccttgcaggatatgggtgttgccattgagacgaaaagtacgccagcggaattgggaaagccactagcggatcagtttaagcttaaggtcgtgaagaacggggattcctctccgttgtttgatggtaattataccagccagacgatacctgcttcggccggtacttatacgatatctgcttcctatggagataatccggttttagcgttggatgcgccctattatttaggcgacactactaatgtggtgattaaggagggcgagcagaagaaaattaccttgagttgcaaggtggccaatgcgttggcttctgcctctttccccactgatacggagttgaagaaaatcttctcttcttattgggtgaaagtagttgttgggaagtcctcttgtaaattgacttctgatagtaagaaaagtgcctattttcaagcagagaaacaggttgccttttattttgagggaacaaaggtgagcggtaaggatttttccgaggagttaaaacataaggatttgccttcggtattgaaagccggacatcatgttaaactgacattgaagttatcggatgatttattgttggatgtcgctaaagttgaaattaaaaaggagacaataacgagcgatatcccgatggattggttgcctaagccgaaagttgaggcggaaggatttgagaataatatactttcctttgctgagacagagactaaaacggcaatattgaatttaaatacggcttcagcactgcaagacttgaagctgaaatttacttttggtgatccgcaattttcaagcttgaatgataaggactatcttttatctgttccggcagataaagcggaaatggaaaatgtgttaggcattgtattgcctgagattggtgtagataaagcctctttagatttgacttccattgtcgctaagttgcgaacagatgcgggtacgacagtagaaaataagattgaagtagatgtgagagcgaataatcgctggagtagtgaggagattaaagggcaagaaaacccaagccgggtttatacgttgaggtgtaataagccggaaatggcagtatctgttcaacccggaaatatctggacgaaagagtttacgattgatgaactgaccgttactacaggagatccggaggttatcaagtctaagttgaaatatcagtataaagaaaagtccggaggtgatgatacttggaaagacattcaagatatgaaagtgttattcaatgaacatccccaaaatagatcatatcaagtgagagcggtttatcgtgatgtggttatgacggatgctattgatgtggagctagagaatccggtgcagttgccgaattctgggatggaggagtggcaagtaaagctgcttggttcatttgttggtattcctgacttctggaataaatattattattacgattatttgccttataaggaaggagaaactgatattttttggactacgaataatgagcgttctagagcctattcagtatctcgtgttcatgtaacatctagcccttgtgttagttcttcggaaaatattaggcatacaggttcttattccgcattaatctatacatcgggtcatggaggagagtatgcttccacaaatggtacaatttatccagcaggggctttcgcaggtagtctatttattggaaaatatagttggaatgataagacagaatctattactccaggacatgctttttcctcacgtccatcagcgttaaaattttattataactatgtgccaaagaataccgacacattcaaggcttatgtggagttgaaaaatggagaagaatttgtcggttccggaacatttatttcttctacttcgaatgaaggctgggcagaagcaactgttactatagagtacgttgatcagccgaaggaggcaacttcaatttatgtacaatttttatcaacgacaaagacctctttttcagaaggtgattttgataaaaataagggaataacatttcctgtaatgggtagttggaatgcccatattggtagtatgctttatattgatgatctctctttaatctatgataaataatgaggagggttgtgtttatttactgtatagaataaatggaaaaatgagacactttgtttatatcttatcgattctcttctttttgccaagttgccagaaagaagactttgtcagttcttctcaaggaaagggaactttgatattggaagatctttctgttcaagtaggaaatatcaatacggtttttacccgggccgtggagaatgatctatatgtggagatttggcaaaacggtcaattaatgagcgggcaacaatatgaaccgggaaaagtgcctgctaagctggatttgcctgccggaagctatctgctgaaaacctataacctagcgtataaagacatgcccaattgggtagatacagaaactggtggagcagccttttatgctgaaaagaattttaagatagacgctggtaaaataaactatctgaatgtagaagtcccgatggtgaatatcggtgtttccttaaaactcccggaaggttttagtgatcgctttaaggattatcattttaccgtacaattcggaaaccgatccgtagaaatatccaatggagaaaccgcttatttcccctcgagtgaagtaacttacattttaagtgtcacaaataacgatggtgaaaataaaacgaattcaaagacgatcaaatcaccagtggcaggaactatatatgaaatctcttatggctatgcgactaaagggttgattgttaatgctaaatatggcttatgaaatgaataactaacggcttcccaagccgttagcttaccactgggggtagccgctagttattcacttcacaagctataaacaaggggggtgtcgttctttacatataatataaaacgtacgtgcgtacattaaaatatacagtctctctctttaaaggcaaatccaaaaacatatccagttacttttctccccttttggattaaaaagtatcttaactgtatcgttcaacgaaactaagtgtgttggccaagtatcttagtttcgttggccaatgcacctaggtgcaaatatgtattaaagcatatggacaatttccatccctcgtgtcccaaccgttattcgcaaattattccttaccttttcttgataaaagaagatttcttagcgaacaggtataagaattggagatttttatctaagtttgtcagtatacatcaaaaagaaaggaagatcttatgatacctctgataaccattccctatgccgtggctgatttcgctgaaatacgcgaacgtggcttttattatgtggataaaactcggtttatcccttatttggagcggtataaggctccggtgtttctgcgtccgcggcgttttggtaagagcttgttggtctctatgctcgcccattactacgatcgcagtaagtctcatcgctttgaggaactttttggggggacttggatcgggaccaatcctacgccggagcataaccaatacatgattatccgctacgacttctcgaagatggtgatggatagcacgatggacgggttagagcagaattttaatgatctgaattgttcccccgtggagatcatggtagagcataaccgtgatcttttcggtgattttaagttctcagtgagaggtaatgccaccaagatgctggaggaggcgttggcttatgtccgtatgcgcggcttgcccaaggtttatatccttattgatgagtacgataatttcaccaaccaattgctcacggcctataaggacccgctttacgagtctgtcaccactggcgagagcttcttgcgtaccttcttcaaggctatcaaggcgggtatcggcgagggaagtatccgtacttgcttttgtacgggtgtgctgcctgttacgatggatgacttgacgagcggctataatatcgccgaaattcttaccttgaagcctgacttcacggagatgttgggtttcaatcatgaggaggctgccgaatacctgcgctatgttattcgtaaatatggcaataatgaggatcgtttcgacgagctgtggacgcttatcgtaaacaactatgatggctatcgctttctgcccaacgcgcatccgttatttaattccactatattgacttattttttcaagaacttcgccgagctgtccggtggtgtccccgatgagatggtggacgagaaccttcgaacggacgtgaattggatccgccgccttaccatcaccttggagaatgcgaaagagatgctggatgccttggtgatcgatggcgagttgatctactctcaaccggatcttaggagtaagttcaataagcagaagttcttcgatccggatttttaccccgtcagtctatattacttgggcatgacaacgttgaaagataattatgtgatggtgcttcccaacttgaccgctcagagcatctacatgaattattacaacgagttgaatcagattagcgatgacgctcgctgttttgttcccgcttatcgcctgtttatggatcatcggaagctggagccgcttgtggaaaattatttcaaggaatatctcggccagttcccggcgcaagtattcgacaagatcaacgagaactttattcgttgctctttctacgaggtactgagtcgttacttgagcaactgctataccttcgccgtggagcagaacttgccaagcggccgtgcggatctggtattgacgggcatatcgggcaccgccttccacaacgattgccgggtggtggagttcaagtatttcaaggcgaaagacgctaccatggtagaggccttgaaggtcgttcgtcccgaagatgccgatcaggtgagaagatatgccgctgatatcaatcggcaattccccgcttaccgcatgcgagcgtatgtggtgtatatagcggcaggaaaagtttgtaagacatgggaagttattaatctctaatgtaaaggacaagacatgagacatttgttgattattctattatgtcttgatcggcaatatatactatgcgatcgaaagaggaatatatccatccttgaatgatattccaatcttttttatctaaccaaattattccgtacctttgcccctcaaaaagagaacacaaggtatggaaaaacattttaagagaacgctgattactacggcgttgccgtatgcgaacggaccggtgcatatcggccatttggccggggtatatgtgcctgctgatatttatgcccgttaccttcgtttgaagggagaggaagtgttgatgattggaggttcggacgagcatggggtacccatcacattgagagcgaagaaagaggggattacaccgcaggatgtggtggatcgttaccacggtattatcaagaaatcgttcgaggagttcggtatcacgtttgatatctattctcgtactacttccgctatgcatcatcagatggcctcggattttttccgtacattgtatgataaaggtgaattcatcgagaaaacaagcgagcaatactacgatgaggaggcgaagcaattcttggccgaccgttatatcacgggtacttgtccgcattgtggaaacgagaaggcgtatggtgaccagtgcgaggcttgcggtacgtctcttagcccgacggatttgatcgatccgaaatccgctatcagtggcagcaagccggtgatgcgtgagacgaagcattggtatctgcctttagacaagtgggagccgttcttgcgtgaatggatattagagggacataaggaatggaagccgaacgtatacggacagtgtaagagctggctggatatgggactgcaaccccgtgcggtgagtcgtgatttggattggggtatccctgttcccgtggaaggggcggaaggaaaggtgctgtatgtctggttcgacgctccgattggttatatctctaatacgaaggagttgttgccggatagctgggagacttggtggaaggatccggagactaaaatggtccatttcatcggtaaagataatatcgtgttccattgtatcgtgttcccttccatgctgaaagcggaaggttcttataacttgccggagaatgtccccgctaatgagttcttgaacttggagggggacaagatctctacttcccgcaactgggcggtttggttgaacgagtatctggtggatatgccgggcaagcaagacgtgttgcgctatgtcttgacggccaatgcgccggagacaaaggataatgatttcacatggaaagattttcaggctcgtaataataatgagttggtcgctatcttagggaacttcgtgaaccgtgcgttagtccttacggataagtatttcgagggtaaggtgccggcggctggcgagttgacagattatgatcgccagaccttgaaggatttcgcggatgtgaaagagaacgtggaacgcctgttggatacctaccacttccgtgacgctcagaaagaggcgatgaacctggcccgtatcggaaataagtatctcgctgatatggagccttggaagttggcgaagacggatatgcctcgtgtcgctacgatcatgaacatcgctttgcagattacggctaatctggcgatcgcttttgagccgttcttgccgtttagcatggagaaactgaacaagatgctgaatgtagagccgttgggatggaatcgcctaggtgctacggatctattggaggccggtcatcaattgggcaaggccgagttgttgttcgagaagatagaggatagcgtgatcgaggcccaagtgcagaaattattggatacgaagaaagcgaatgaggaagcgaattataaggcgaaaccgatccgtgagaatattgagttcgatgattttatgaaactggatatccgtgtgggtacggttctagaatgcacgaaggttccgaaagcggataagctgcttcagttccgtatcgacgatggcctggagaaacgcacgatcgtatcgggcatcgctcagcattataaacccgaggaattggtaggcaagcaagtttgcttcatcgctaacttagctcctcgtaagctgaaaggtattgtttccgagggtatgattctctccgccgagaatttcgatggaaagctggccgttatcactccggagaaagaggtgaaaccgggtagcgaggtgaaataataaggtagacgcaataatgagggggctattccgttttaacgatgggatagccctatttttgagtggataagatgcttgagaaacagatacagatggtagatctgcggaagcagtatgaacgtttgcgtagtgagatcgatcccgccatgcaaacggtgataaatgcttgcgcctttatcaatggccctcaggtgaagggattttgtaaccatttatcagattatttaggtattccttatgcgatcccgtgcggcaacggtacggatgccttgcaaatctccttgatggcattagacttacatccgggcgatgaggtgatcgttcctgcttttacgtatatcgccgcggctgaggtcgctttggctcttggcctagtgccggtattagtggatgtagatcccggtacattcaatatagacccggaaaagatagaagatgccttgtctgaaaagacgagagctattatcgcagttcatctttttggccagtgttgtgatatggaaccgatcttgcgtattgccagccgtcataatctatatgtgatcgaggataatgcccagtccatcggtgctaattatactttctcggatggaacggtgaagaaagcctgtacgatcgcctctataggaacgacctccttcttcccttcgaaaccgttggcttgttatggtgatggtggggcgatgtttacttccgacgcacgattggccgaacgactgcgaatgatcgccaatcatgggcaaaaggtaaaatatcatcatgctttggtgggctgcaactcccgtttggataccttgcaggccgctgtcttagatgttaagcttcggtatttggatgaatttgccgccgctcgttgtaaagtggctgctagatacgatgctgccttttccggattggatgctgtacgcaaaccactaaaatcagccttttcatcgcatgtttatcatcaatatacggtacagctagctgtagaaaagagggatcaagtacaagctgcgttaaaagaacgaggcattccttctatgatttattatccattgcctttgcaggagcaagaggtgatgagggggcgatgccggatttccggggatttgaatgtcgcttctcgcttgagccgatccgtattatccttgccgattcatacggagatgacagaagaggagcaggcttatattatagaatctataaagagtgttttatgaataagaagatacgtttcgccgtgatcggctgtggtcatataggtaagcgtcatgccgagatgattacccgggatgaaggagcggagttggtcgctttatgtgatatccgtccgaaagaggagctggggatcgaggcttatgcggtccctttcgcccgggatatagatgaactattccgtttgggattggatatagatgtggtgaatatttgtacacctaacggcttacatgccgagatggcgatccaagcgatagagagtggacatcatgtggtcatagaaaagcctatggccttgaccttggcggatgccgagaaagtggtttatacctcgttgagattccgtaagcaggtattttgcgtaatgcaaaaccgatattccccgccttcggtctggatcaaggagatggttgagtccggaaaattaggccagatttatatggtgcagctgaattgctactggaaccgtgacgaacgctactataaacccggaggatggcatggcgacgctgccttggatggaggtaccttattcactcaattctcccatttcatcgatattatgtattggttattcggggatatttgcaatatccagtcccgtttcgctgatttcaaccatgagaagctaacggcgttcgaggattccggtttcgtcaatttcaatttcgtgaacggaggaatgggaagcttgagttattcaacggcggtgtggaataagaatatggagagcagtatgttgatcgtggcggaaaatggaagcgtgaagatcggtggacaatacatgaatgaggtggaatattgccatatcaaggattatgagatgccggaattggctcctaccaaccccggcaatgattatggcccttacaaaggctccgcccagaaccacaacttcgtgatccgtaacgtagtcaacgtcctttccggcgctccgggcgagatcataacgaccaacgtgttggaaggcatgaaggtggtggatatcattcagaggatttatgcttcttcttgaaaggatatgcaagccccgtaatatccgacattctgcaagacttcgtgaaaactttttaatacagagctgcttattaaattggactcttgatcaagcaatgtttgtggtgctttcatcgtgagaacgatgatctctgcattttttaactcctcttttagctgttgtgtacttggatcaatgatatcgctattagagtatactaattgccgtttatgagtcgcctctggtataatcagataactgatcaggtctggggctgtgactaaaggacttccttgcccggaatcccaaacgatcaagctttcgttttgaaaaataatcttgataagattttctggggtttgatcttgttggatggtcatcaacccgctatcaaaacctccgatagcggtgttttttgcgtctaggatttttccctgacatacgatttgagagtggtaattaatagtgttaagtacattttggatagaggagatattcggctttattaaatattgttcgtttcctatgatttttcccaattgtatacattttgttattgtccctttgatcagaatggctttgctcattaaggcccggtccatcgtccacatcgttatgccaccaacttggtcgaattcacgcatgcttagggctgatcgtgccagagcctcgatcgtggtagaggcagaagcttcacgactatcgcttacttcatatacgattttatagtcagagctgttggtaagtacgcaaggatttacatcggctccatgcgtcgcgaaagttgtcatctgcaataagggaacggctctgcctgcgccatcagcgttaatgacggtaagattcaatttagccccgacaaggcaagaaacaagagtcgagattcctcctacctcaattggcacgatataaccgagttctttccctcttttcttgagttcttcttggattgtattgaccgactggatagccgcatctggtgtaacggcatcttttagtttcgtaggggtacctaaataagctaaaacaatagcgcatttagagtcgttttccggaatatcatctacatcgatgatggaaacctcagtacgttcgtaatgcttctttgtgaaattttggacaaatagcatcgcgctatcatacgttccaccaccgccactagctaggaatgtagctcccttgactagattctcgaggtcgatttgcttaagaggttcatttttctttttcatggtttgtcgtattatattgatttcaataagtgcttaacatgctcggctcctgtttcatccgctatatccaatgctttttttatagcgacttccatattttccgtatcgccaagagctttatggcactttgcctttaggaagtaaagctccccgaggtaacatttttccttattagcttctatgataggaaatgacatgtttattatatctaaacaagatctataatcattataattcaagtggaccattcctaataaataagtatagaaaggatgagtgatatcagttgtcgaggtcttatcaggtatgaggcttttatatccttcttcgagaatacttaacccggtttctttctcttttaaggcataagtgaacccgtaaaacaatttgctgaccgcagtgtagtaagaaaaagaatgatcttcagaggttttgtggactttgagggcaaattcctcacagcgttcgtaattcccttgcaaaagctcgttccatgccacgacatgataaaagatagctaggacaaaataatcctttaccgaggtgtaccgatcttccatatcctggcttaatttcttgaacacctcatattctcccgcttcaaaagccgtaatagaggcgaacataaagtagaatagattattgatagaagtagcttgcctcacgttttctcccatttggtcaatcaacacctcatactcatgaagaaataattttagcctcttgaaatctccgatccagaagagggtattgataagcataatataaccggtctgcagaccgatcaaattctcggattcctttgtctgggcgatatttttctcacatagatctacgcacttgtccagatctatttgcatgaagtagtaaatccaaatgcaatacgtgatggtatccatgtaatcgaaacactggattttcttacttagctggtttgcttccgtgaatagatccatcgggatcttactcccccagccaatcgtattgcgatagcataatcccagttttacggtggcttccagacggatccggtcgtgctccatatcatcggcaagatcatccagatacttcaacatattcttcaacagaggaatagcgttctcaaacgccgatattttcatcatggcgttcacggagatcatgataaacctcaatgcgctgtcgtattcaccggacatctcatagtgatacgctatatctccagccatttcttctatcttgtctttgaagagttcttgtaatatagttgctatatccgaatgcaagaccatgcgttgggttaagctaagttcttgataaatgtattgttggaatatataattagagaaatagaatttagatacaaactgttttccggaccgtacgcaatctccttccataacgagatgatgctgtttctgtaattttttggaaaggctcatcagcaaattccgttccgattcatttagggttctagataatacttgaagtatgaaattcggaccttgaacgcttgcgtgtgaaaggatttccatcagcgagtcctctaagttgctgatccgttcttcaatgataccctcaatccggatcggataatcatgccactccatgttcttttggtttttccagatctcatcttcttgataaacaaccccctcgtctttgaacaagttcatcatttccgtgataaacaatggattaccattcgtccgctcaaatagtttttttcggaaagatgctgtatactggttcttatccctgtcaagaatttgattcatgaaatcttttctgtcggcctctgacagattatctaattggatgaaaacatttccgaaagctatctttatttcattgataagcttttgcataggatgccgcccttcgccagtatagccatcgatatcttcactgcggtaacagccgacaatcatgagggaagaacgtcgtaaggatacgattagctgataaagtaattcgacggacggtttatcgatccactgtaggtcatcaataaataggacaatggtatatttctcactaatggcacgcatataattaacgaattgctcgatgattttcgattcgtctatagatacgtcttcccctgtcttttgcgcttttagccgttcaagaatatttgtcttctcaatgattgattggctaattccacttaggatactacctcccggaattaaactacctatcaagtccggcgcatgggtcaataacatggaggtagagaaactaagtaattcctttaggttttccttactccatctcttattggccgagtcttcttgaatatcctctatcagttgcttaagtatttctttaaaaggttgatacggaatattgtattcggaaggtatgctgcagaacgaagaggcaatcactattctttctgtctcttttatgtcgtttaagaaagtttgtatgagaactgatttaccagtccctgcttctcctgttataaactggacttgtaattctttttggctagaaaccttttttaatgaattttccagcaaagcgatctctttgtttcttcttataaaagataattgttcttccataatactatactcaacgattagtaatgaaacaaagatgtgaaaaatattcaataaaagaaagtggtttactgaaaagatgttttattttcatttttgtaccgtgaggatttatgcagggagggcataaatcctctggatacttaggttttagatctcgtcggggctctcgctatctcctccacttgggttctccgcttcgggaagtttcgctttttcgaaaacggcgagttttttggatacccgcaaagcctttcccgggctgaagaccactttcggttctttaatcaggttattggagaactcctcggtggtagcggctcccgtagagcctaccccaaaacggaaattacccaattcgcctacattcaccctgcgcccttgcgagagatttcgtttcaacacgatattgatacggtcgagtaccgccttgacttgggcggagcctactccacttccatctgccacttcctcgaggaaagtctcgaactctacaagatctccatagaccacttgcgcatactgtttcttgggtgtttctgtcttgtcgttacccaagttctttctctcgatcaatctgtactttactgccataattcctgaattttaaaagatgattaaatgaattaccttgttttcgaaaacatgacaaaggtatcgcaagccgtatgaggcaaatcggtctgtgtcggtttatgtctgtcaatgtccgtgtatgtgcctattagtctacgagtgcctgtttcgcttcctttagttcacaagactagtaaaatgtaaaaatgtacaataagctatattagaatgggtgtgttttgtatatttctgattattagtttattatatctgataggtgcgagactttttaattagtatcaatagaaatccggatttctattgatactaattggtgttttctattgatactaattcatatttccatacgtactatttgttattttatacataaagtatgaaaagcttccgggttttgcccgttacccaagagtaaatgtttatctttgtggcacttttaccgtaaatatcaaatggcagaacaatcactaaaagataagacagcgaaagggctcttctggggaggggtgagcaatggggtgcagcagttgttggggatgttgtttggtatttatctggctcggattcttaatgcggaggattatgggttggtagggatgttggcgatatttagtggaattgctggtacgattatcaatagtggatttacggtagcgctaacaaataatcaaaatgcgactcataaggattataatgcggtgttttggtttaccttttttatcggtttgattttatatttagtgctgtttctggctgcgccgttgatttctgagttctatcaccgaccggaactaacagctttatcccgtgttttgttcattagctttttcgtctctgggattgcttccgttccttatacggtcatgtttaaaaggctgatgattaaggaacaggccaaaattgatattctgtctttgttcttctcggggattataggggttagtctcgccttaaatggcttcgcttattgggcgatcgctttgcagagtatgtcatacgtgacgattaattctttgctgaagtgctatgtctcgccgtggcgtcctacatttgaatttgatttttccccattgaggcatatgttctcttttagcgtgaagctcttcttgaccaatgtgtttacccaaattaatacgaatatattttctgtattattagggcggttctatgatgctcggcaagtaggattttattctcaaggtaataaatggcagggtatgggcaatacgtttatttcagggatgatcaatagtgtcgctcaaccggttcttgtctcggtgggggatgacttgtgccggcaaaggaatgtgtttaggaaaatggtccgttttggctcctttgtatcctttcctgtgatgcttggtcttgcttttgtcgggaaagaatttatctgtgtgcttatcggggataaatggctacccagcgtacccttcctacaacttttttgcatatggggagcggtgagtttcttatggaatctatattcaaacctgttgatctctcatgggaagtctgatttgtatatgtggggtattgtttttgttgggatgatacaacttctctgtgtgtttgcttttctgcgttatggtatatattatatgttaggggcttacatcagcgtttacttcttgggaatcctattttggcattattttgcctcacggcttatctgtttgggcctaatatatgtgataaaggatatgttaccttatttgttcgctacattcttgtcattttttatcgtatgggtgttgacctatcagatagaagatatgttgctattgctaatcttgaagatcgttttgtcagtactctcttatgtggtaattatgtggctaggtaattcagtgatatttaaagaggcattgacctatttaagaaaaaagtgaaacatgaagcaatatataaatcatttgtactttaagattaaggtcgcattcttttattggggtgtgtggttgattaatcagctaatacggcctaattgccttgatgtgaaaaatattccgatcattattaataataggaatcgattaacttatatgaaaatgttgatatcctctttagagaaaagaggatacaataatatatatattattgataatgattctacctatcctccactattggattattatagtaaagaatgcatttatcctgttttttatttgaataaaaatgtgggttataatgctttatgggattccggtttgatccgtaagttcaggaaaaactatttcgtttatacagattcagatgttgtcttatcggatgaatgcccagctgatatcttggaaaaggcttattctatattaggacgatattcgaaagtacataaagtagggccagccttagaggtgaaagatattccggaagaaaattggaaagcagtgtggaatactcaatcggatagttggcaaaaagtgatacatggtgatgattttttactttatgaggccatgattgatacgacatttgccttatatagaccttttgtaacgaagcacctaggtgttttccgtaatcaaattcggatggggtatccttatgtcgctaaacatatgccttggtatgagagagaaaatcatatgccggaagattcattatactatcaacaaacagcaaatattgaatctacttggtataagaggagctaaataatgatcaattcatgtagttatgaaaaagatagtattgatatttaatcattttgagagagagcattttggaaaagatgtctttctatttccttatactttgtctaaatgtgtgggagggaaagccatgattgtatatcctgagacatcttcaaataaaaattttccaagtgaatatagaaatgtaaccctaaaatcgcttccttttaaggggaaagaatctagctggttcttatatcgggaatggaattttttaattttcttaattagaaaatccaaagagattgatatccttttacggatacattttacgtttatgacagctttatttgtgctgttatataaaatgataaatccaaaaggtattactgccgtcaagttagatggctatctagatccattattctttagttctgattctctttcgttatttaagagattgaaacataaagtattttttagaactttaaggcaagtggatttattaacggtagagactcaatgcttatatgataggttatataaggaatttatagatgtttatgatataaaactgaaattggtgttaatgccaaatggctttgatgaagaaacattgaaaactctgtccattgtagagaaggattttggacataataatgattacggtaggtagattgggaacatatcagaaaaatacggaaatgcttttaaacgcattggacttaatggaacttagggattggaaagtgtatttgataggtagcatttcagaggatttggacttttttttgaaggatttttttatgagaaacccgtcaaaaaaggaatcagtcttttttgtgggtccaatttatgataaaaagagtttatgggagttctataatagggcgaaggtttttatattaacatcgagatttgaaggctatcctttagttctaacagaggctaagagatttagaaattatattgtttcaacagaattggatgcttcggaagatttattagagaatgggaaatatggttgtttgatagcccaagagaattataaggaactcgctttattttgtcaaaaaatcatcaatggagaaatttgtattgatgtgtatgaaaattatgataaagaagatatctcttgggatatgattatgagaaaacaagaaaaagtgatgaacaaatttttgtaataaggatggtggatgtttctgttatatatgtcaattatagaactatacaattgatattggatagtgtcaaatccattaaagaaagaaccttaggcataagttatgagattattgttgtcgataatgcttgtgatgaggaatcatttcgtttgataaaagaccgttatccggaaataatatgtattcagtcagttgataatctgggatttggtaaaggaaataacttggggattgagcaggctcaaggtgattttgtgttatttctgaatccagatacagttttacggaataatgcgatagatatactttgtcgtttcatgaaggataatccgtctgtagggggctgtggaggtaacctatatgatgaagagggaaacgctactacttcttttagccgtaaatacccgtcttttttatgggaactattagggatcttatatataccttcactttgtatttcgtcgaggcgttctttattctttaattatgaaggaaagccgataaaggttgcttctgtgataggtgcggatttgatggtaaggagaacggtgctatcctctgtaggaggttttgatgcggatttcttcatgaattatgaggagacagaattatgtcttcggattcatcggtcgggttgggatatatattcagtgccttcggctcaaatcacacatttggaggggcgtgcctcttatataaaacaatctcgtctttatttcttgtatgagggacaatatatttatttccggaaggtttatggtaaatttgggtgtcgattgatttttgccattacgcaactgaagagttatgttcggatttttcagtttcttttgttgggaaatcggaaaagaggggcttactggaaaatgaaactagagacgaacagggaggtctggaactccgaaagaataaaacgtattttgaaatgaaaaagaagctagtggtttttcatccggcgatagctccttatcgagtagatttttttaattccttgaataaggagtttgatgctatattctattttgagtttggagatgtattggagcaatctttcgctcaagataagttgagaggacgattgaagttcgtaccccattttttggctccgggattatttggaattaagaatctaaggacgcaggttttctcgatattgaggaaggaacagccgaatgtggtattttgtagtgagtataatatattgggtttattattgttggtttataaatttctattcaactggaaattgtctatttttacgatctgtgatgatagcaaagagattgctgaaagcgcaactcttgtgaaaagatgtatgcgttttattgtggttaagttttacagtggtattatcttgacaaacgacgatgtgttgtcttggtatgttaaacactttcaggcgaagcagaaatttttgtttttcccgattatccaaaaagatcaagattttaggttgctattggagaatgcgttgcctgtttctaagatgttggaggatacgtatcatttgagaggaaggcaagttctgctgtttgttgggcgtttaatagatatcaagaatttattctttttactggatgccttggccttggtcgtagataggtatcctaaagctgttcttttatttgtgggtgatggtgatcagcgagtcgctttagagcgacatgcggagagaaatggattggctgaccatgtgattttcgcagggaaaaagcaaggtaaggatctatatgcttattataatgtcggtcagatatttgtgctgccaagttattatgagcgttttggagcggtggtgaatgaggcattattggctggttgttataccttatgctctgttgttgcgggtgcggcttgtttgattgagccgcaaaaaaatggtgatctctttgatccggcatctaaaaaggatcttgcggagaaattggcgcaaggtctagagtgttgtaaggatctgagacatatatcgttaaaagcaaataatatgtgttatagttacgatctgtatataacctctttttttaatcagttaaattctataatagataagtaagaatggatattcgtttatattgggagaaagtttattgggcgttggcgaaacgtgtttttaaaagaaagcagaaaacttatgaggattggttggcgaaaggatataccaatcaaccacttgttagctttattatagaatctcataataaaagtgtgggagtcaaacgtattgtcagcgaattacgtgagtatccgaacgctgagatcgtagtaatagatgatggttctgagtacaaacatactaagtctcttatgaggtatcttactcgtggtaatgaatttttagtacgagctaatgatttatatgagaatgtgatgtatgataaaaccattcgttttgcgaatggcgaatatattgttttaatgcaggatgatgatgagataaccgatctggattgggttgataagggtgtctcttattttaagaaatatccggatatggttattctcggtggtttgaatggattggaatttgttaccgatgataaggaaaagtggggatatgtggatttgtataaggatgatagactacgagataaagatttttattttgtgcatgcagtaaaccgggcccctatgttgttaaacaagagattgttcctagatcatttgggacatattgatttctcttttgctccctttcaatgcgatgattgcgagctgtgtctacgtgcgtggttgtgtggcttgaaagtagggtggtataacgccggctttaagtccatgatcgctggtggaatgcgtatttggaataaggggttgatgggatttcaagaaatcaagaatcgagggaaattgtatgagatgtataaattttcttcaagtaaagtctctgagttagtagaggtcgcaaataaacaactaaagtcataaaaagatatgtccattgatgaatataggagaataaataaatcttttaagagagttctgatatttaagatagggctcaactctggttttttttctgaatataataatatgattctggcaatgttgtattgcttagaaaaccggattcaattcaaactatcatcaaatggtgcgaattttaacacccagtttggttggaatggctattttgatagtttttgtgattctgtagtagataatagattacactatagaacgttagattggagatattctttgaaattagttgttaaacgttttgatcgattagctgtacattctcttttttcatatatgagtttttggaaaaaagagttattaacgcaagatgtttttggcaaatgccgggataaattgaggtatcgaaaaagacacgttattccggagctgggatttcgaggaagtacgcaggagatatgctctatgcttgtctgtttaacttggaaatataatgattctacgaataaaagaataaaagaaattctaaagactctttccctccctgataaatatgtatctatccatgtgaggagaggtgataaaattgtagaaagtccttattattccttagaacgatattttgagaagttaggtacgaaaaataagaatttatttgtagccacagatgattatactgttattgaagatataaaaaagaaatatcctgattggaatgtttggacattatgttctcctttggaaagaggatatgttcagtctgttgcggataaagagagttttcaggagaaagatcggaatatgattttgttgtttgccacaatggagatcttgaaccgatcagagcgatttgtaggaacctataattctaatataggaatgtttcaaggtatgagaaatccgtcgatttgtagtggtgtggattttgatcattgggtagtttggtaaatggagactggagtatgagagaaaaccaacataccgaatttaaggagtcatggcatgacgaatatacccgttatatatcagctttctgtaatacggagggtggtgtattatatatcggtatcgatgataaaggagaagttgtagggatagagcagccaaagaagttgattgagaaacttccgaactttatcgctcagaaaacgggtattatgcctcttatccatttgagggagaaggctggtaaagaatatttggaaatagaagtccaaccttctgccatgccgatttccgtgcatggacggtattatacccggagtggaagcgttacttccgagttacaggggaatcagttaaatatgttcttggctgcgaaaatggggttgacatgggaaagtgtgatcgaggaggatttctcattggaggacatagataccgagactgtagaacgttttaagctattggctaaagatcgggttccttccattgagcaggaaacggatctgctggctttaatggagaggttgaatttggtcgtaggaggccgtttcaagagagccgctgtggtcctgtttggaaagaacgtgcagagatatgtgttacaagctcgtattaaaataggaaagttccttaccgatacggaggtactgacaaccgatattatcgaggggaacctgattcagcaggtggatcgggctttggatatattgcgaacgaaatatttattaagttatatatcgtatgaggggattcataggcgtgagaaactggtttatccctacgaggctctgcgggaagccttattgaattcgattatccatcgagaatattttgtttcttccgaaattcaaattcgtgtttacgaaaataaactggtgataggaaatgaagctcgtttacaagatatcacggtagaggatttatctcgatctcacccctctaggcctcataataaattgatagcggatgtcttttacaaggcaggttttattgaaagttgggggcggggaacacaacgtattattgataactgcgtagctgagggattatccgctcctatgtatgagtataagatgggatttttgtacttaactttttctcatgagcgggtaaatgagcgggtaaatgagcgggtaaatgagcgggtaaatgagcttactgatacagagagagctgtctataggctcgttgcaaataagccatctgttactcaattagaattagctgcggagttgcggctaacggtacaatatattcgcaaaataatgaaggcgttgaaagataagaattacatagaacgtgtaggtgcagataaaaatggttattggaaaataatagagaagtcatgaagatattgatattaaatacctctgaattaactggtggagcggcagtcgccgcgaaccgactagcgaaagcattgggtaaatctggtgtagaggtttctatgttagtacgtgatcggaaaacagaccatgtaaaagttttctctgtaaataattcatggacttcacataggcttaattcttttcgtttcatttgggaacgactgataatctttatctgtaacttctttagcaagaagaacctctttcaagtttccatagccaatacaggcacggacttatcgaagcacccattagtgcaacaggcggatgtgattcatctgcattgggttaatcaaggatttctatctctttctgatattaagaaattagtaaataccggaaaacccattgtgtggactatgcatgatttgtggcctgctacggctatttgtcattatccgggaggatgtgagaagtatatatcgaattgttatcagtgcccgatgctgaaacgaaatccgttttttgatttagcggcttctgtttttaaggagaaagggaaaatagggttatctaagattacatttgtcggttgtagccgatggataatggaagaggccaaaaaaggcaattggttgagaacagcctgttttacctcgattcctaacccgattgacgtgacagcctttaagcgtatggaaaagcgggtggcccgtaaacgattcggcctgccggaagataagttccttcttctttttgccgccgctaagctttcagatacccggaagggagcgatttttttgatcgaggcttgcgaaaaactaaaagagaaataccaagatcgcatagaaatcgtgttgatgggaaatagctcggaagaattgattagccagtttccttttaaggtgaatacgctgggatatatatcggatcaagactctatgatttccgtttatgcctgtgccgatatgttcgttattccttcgttggaggataacttacccaatacgattatggagtcgatggcatgcggtacgccttgtgtgggatttgagacaggagggattccagagatgatagatcatttgaagaatgggtatgtagctaaatataaggatactgaagatttagcggagggaattaagtggataatagatagccgggaatctttacaattaagtgaggcttgcattcgaaaggtccatgattgttatcaagaatcggttgtagcggggaggtatattgatttgtatcggagtttaacttcgccttagaatgaattctttggatatttcatctatatcaagaatatagttacttttgtgaaaaatggaagttactatatagtataggaaggaatgctatgagatgaaagagtatttatcaaatgttttagagatattggaagaaaaaggcgttttgaacgaatcgtatgatctggagttcaaaagtgcgaagggggggcttcctcggtctctttgggagtcttattctgcgtttgctaattccgagggaggtacaattattcttggcgtttccgaaaaagataattattgttatttggatggtttaggagaggatgttgtgcgtaagtggcttgatgatttttggaatcagataaacaataaagaaaaagtgagcgttaaccttttgacggctaaggatgttcgtatagaaaaggtgaaagatgatattaatgtattaatcataagggtgcctcccgcaagttttcgttatcgtccggtttatataggaacggatatgttaaaaggaacttataggcgagatcatactggagactataggtgcatgccagaggaagtaaagcgaatgttggcagattccttgcctgataaacccgattctcttgtgttggaacattcgacgatagaggacttggatttgccaacattagatcaatatcgaaatattcttcgaagtgttaaacccatgcatccctttttgacacttgataatcttccttttttgcagaggttgggagcttggaaagtaaatcgagcgacaggaacttatggtttaactgccgcaggattattgatgttcggaaaaacacaatcaatacaagaatttttcccggactatcatgtcgattaccaagagatatccaatcaagggagtcgctggatagaccgtatatatccagatggtacatgggaggctaatctttttcaattttttcatagggtatggcctaaattaagtttttctttgcccaaaccatttttattggagaatgggaggagacgtgatgaaggtgctatccatgaagctttgcgtgaggcttttgcaaacagtattattcatgcggattatagggggcagggaggaattgttataaagaaatatccggatcgattcctgttcgtgaatccgggttatatgttagttcctttggaacagtattataaaggaggatgtagtgtcccgaggaatactacgatacaaaccatgttctctttattaggttatggtgaaaaagcagggtcgggtagtcttcggataatgtcggcttgggctagtgcgcattggagaaaaccgtttatatctatgaccaatagaccggatcgtgtttgtctagatttaaaaatggaagtattgttgcctaaggatagtttggagcacttagaatatatatttgggaaggatgttcgtaatatgtatggggatgctttggttatattgtctaccgctgagatagaaggggttgtctcaaatcttcgattacagggtttacttaataaacattcctcggagatatctattatgttaaaagatttatgttcgcaaggatatttaaatccagagaataagggacgttggacttcttatcatttgaataagggaataggacttaaacaaggaagtttatttgagaacttggatggacaccttaatgaaaagatggacacctcggacaagaaagatggacaccttaatgaaaagatggacacctcggacaagaaagatggacaccttggcagaaatatgcaagaaattaaaagctcagaattaaagtcttatattgtagaaatttgctcaagtaggtatttaacaatcgaggagattgcggtaaaaacccgacgtacttcaaaatatctgaagaataagatagtatctcaattattgaaagatgggcttttagaacgtttatatcctactactccaaatcatcctaatcaagcatataaaaagaaacaacaatgaatcagcaacctacattttcgatcataacgatcacctataatgcggagcgatggttggagcgtacgatattgagcgtacttagccagtcgtatccgaatatcgagtatatattgattgacggagcgtcgaaggataagaccgtagagatcatcaagcaatatgagtccggtatcgcttcttggataagcgagcctgataaaggcttgtatgatgctatgaataagggattgaagcgggctacgggggattatgtgtggttcctgaatgcgggggatacactttataccgcagataccgtgcaaagaattgtggcgtctttgaaaaagaaagtatctttgccagacgtgatttacggagaaacccggatcgttgacgcggagggtagatcattagggatgcgcagattgaaagcaccggagaaactgacttggaagagtttccggatgggaatgttggtttgtcaccagtcgtttatatcaaaacgggagatcgctccgttatataatacggaataccgtttgacggcggattatgattggtgtatccaatgtctgagacgatcgaaaagaatacataatacacgtttgatcctgtctaattttttggaggaagggttaagtagtgtgaaccggaaagcttccttaaaggagcgatatgaggtcatgtgtaagtattatggcaaggtgtcgacgattctgttgcatggttggttcgccgtgagattctattttgccaaatggtttaaaggtagagtataaacaataaattatagataagttttatgcggagtataatgagtaaatggggaaaacatatcgcagcgatagccgtattcttggtattgacggtgatttatttttctccggccgtatttgagggtaaagtcgtccggcaaggggatacggaaaaggctatcggtatggggaatagccagatggatgaatatgagaagacggcccaaccgggagaattcagcgcatggtctgatgctatgtttggcggaatgccttatgtgtcgggatatggaaatccggctccacgatttcccggatatcttttagtggagaagcctttaaaagcgctggggtatatggatgcggggatggtgtttaccggattcgtttgtttctatatcttgatgtgtgtcatgggcgtaaattggtggttggcgatcgctggtgctatcgctttcgctttagcgtcttataatctgatcattatagaggccggccatgtcacgaaagcgtatgtaatcgcttatatgccattaacgttggcgggtatggccctgttgttcaagcgtaagtatttatggggggcggtcgtgttcttgttgggtgtcgctttctctatcgcgaatacgcacctgcaaatcacttattatttattattactttgcttcttcgtttatttgggatatttgttcaataaactgaaggaaaaagcttataaagaactgggtacggtaaccgctattatggctggatgcgtgatattggcggtgttgccgaatgcccagaatatgtatgctcaatgggatttgggacagaactctatccgtggggctacggaattaacgacaacgaccccttcgggcgagaagatctcttccggcttggacaaggattatgcgttcgcttggagctatggaaaaggggagttgttgaccttgttggttccgaatgcctatggtggaagttcgggtggaatgctaggcccggattctgagttatataaggaattaagggcgaaaggcgctcaagtcggaaaagaggtacaggctcctacctattggggagagaagacatttacttccgggccggtttatttcggggcattggtctgcttcttgtttgttctgggaatgttcgtgatccggaatccgatgaaatggtggttattcggaggttctgtctttttgatattgctggcattgggacgtaattttgataacttcaatgactttatgttccattacttgccgatgtataataagttccgtaccgtagagatggcattggttattccgggtatggtatttcctattatcgctatatggggattgaaagaggtgttatccgagaccgtgagcgatgccttgttgaagagaggattgatcgctgctttggctatcacgggggggctttctttaatcctttggttgatgccgagtatgctgttggatttccgttcttctttcgacgctcaatatcagttgccggattggtattacaacgccttgttaatggatcgtgcttccttggcttcggcggatgcgttgcgctctttggtctttatcttattaggggcggctttgttgttctggttctatacctcgaaagatcggaaaaaggtggcgacattcgtagggatcggtgttgcggtcttgatgttggttgacttatggacggtggataaacggtatttgaacgatagtaactttatccgccagaaacctacagaggtatataaagagacggtagccgatcaagaaatcatgaaggataaggacctttcttatcgtgtcttgaatttgaataatcctttcttggagacaacgacctcgtactatcaccattccgtcggtggttattacgctgcgaagctgagacggtaccaagaactgatcgaccaccgtctgcaaggagagcttaactcggttatcggggctttccagaaagcgcagaccgcagaggatttgatgggggcgttcgctgcttgcccgtccttgaatatgctcaatacacgttatattatctataatccggagcaaccgcctttgaggaatccgtttgctttcggcaacgcttggtttgtggataaagtggaggtcgtggagaatgcggatgcggaaatagcggcgttgaatacgatcaatccgttaacgacggcggttgtcgataaacgtttcgctgatgaggtgaaaggtttcacgcctcaattggactctactgctacgataacattggatagttatcgccctaataaattagtttatacgacgaagacgaattctgagcaattagcggtattctcagagatctattatcaaccgggatgggaggtaactattgatggtaagcccgcttcgcatttccgggcggattggatattacgagctatgttagttcctgcgggagagcatcagatcgtatttgagtttagaccgcaaggttatattacggcggcttatattacctctttcagttcgttgattatcttgttgttattgattggtgcggtaggatattcggtttggaaagctagaaagcaaaaagagatataaattccggttggttgtagagacggggcacaccccgtctctacaactagatgaaaccgctattgataaaatcgagcagttttctcgttagggtttcccacgagagagctgctttttctttggatatgttcgcagggatggtggcttgctgtgagggggtgaaaagttcctcgataccttgggcgagggccgttgcggatatctcaggcactacgatgcctgtacccggcttttcgatgctgttcttgaaatcgcctacgggagtacttaacataggtaaatcgtaattgtaggctacggatacgacaccactttgagtggcggagcgataggggagtactaaggcatccgccgctgagaaataaatggggatttcctcgtcgctgatatattcacagtggacgaatatacgttcttttgccggagatgcatcgatcagagcctgatacttctcgaaactaccgtaacattcgccggctataatgagatggtaatcctcgttaagctgtcccatcgcttctatcagcaggtctaatcctttataatcccgtatcagtccaaagaatagaagattctttttggacggatggattcctaatttccggcatgcctcgttcttgttgatcttactcccgaaatgattataaagcgggtgtgggttctggatatatttagcgcccgggtaaagtttccgcaaatcataccgcacgttatcgctcatcacgataaagccatggcattgcttgaaaagtaacgaagctaaaggcttgtcgaagaaacgcggctcatggggaatcgcgttgtggataagggtgattaccttacaatgctttttcatccgatttgctacgtgggcgtatccgggaacgaaaaaggacatccagtaagagataatcagtacgtccggcgcataggaacgaatggcgtttacggtactgaaataactaaccgggttgacgctatctaatactcgcacgctctcgatttcgatcgcacggtctcccgcttctacgtattgagtcttgccgggaaataagatatccggataaagacgtttgaagttgaaagcctttacttcatgaccttcttttactaattccgtatagagcatcccgctgaattgggcgataccgccacgatagggataaatgggggagagaatagcgaaacgcatggtaattgaaaattaagaattgaaaattgaaaattaagaatcgagaactacaggagctgccctcccttcattatcaattctcaactttcaatcttcaattaattagtatctgtaatgatcagccttgtacggtccttctaccggtacgccgatataatcagcttgcttttgtgataatgtagataatttcacgccgatacgttccaagtgtaggcgggcaacttcctcatccaaacgtttcggcaaacgatatacgcctacctcataggccatttgccataaatccatctgggcaagaacttggttcgtaaatgagttgctcattacgaatgatgggtgtcccgtagcgcaacctaagtttaccaagcgtccctctgccaataagaagatggagtttccgttcgggaacgtatatttgtccacttgaggcttgatattcgtgtgcttgatattcggatagttgacaagcttatccacctgtatctcgttgtcgaagtgaccgatgttacatacgatcgattggtctttcatctgtgtcatatgctcgatcgtgatgatatcgcagtttccggtggtcgtaacgaagatgttaccctctttcacggcctcttccatggtcgtaacctcgaaaccttccatagcggcttgcagggcgcagatcggatcgatctcggtcacgagtacacgggccccgtaagagcgcatggagtgagagcagcctttacctacgtcaccatatccggcaacgactaccaccttgccggcgatcattacgtccgtagcccgcttgatgccgtccgccaaagactcacggcaaccgtataggttatcgaacttggatttcgtcacggagtcattaacattgatagccggaaccagcaactcacctttctccatcatctgatacagacggtgaacgccggtggtcgtctcttccgatacccctttcatctcggctaccgtacggtgccaacggctgttatcttcttgaaggatacgatttaatgtatccaggattacctgtttctcatgatttccgcctttgcggttgatagtctccgcatcgttctccgcacgatagcccatgtgaatcagcaaggaagcgtcgccgccatcgtcaacaatcatgtgagggcctttaccttccgggaaacgaagcgccatgtccgtacaccaccaatactcctccagcgtctcgcctttccaagcgaataccggtacgccgtccgctgcgatagcggcagcggcatgatcttgtgtggagaagatgttacagctagcccagcgaacgtccgctcccaacgcaactaatgtttcgattaacaccgccgtctgaatagtcatatgcagtgagccggtgatacgtgcgcctttcaagggtttctgatcggcgtatttctggcgtagcgccattaatcccggcatttcgtgttcggcgatctcgatctctttgcgaccgaattcagccaaactcatatctgccactttataaggcagattagttggaaataattgtgacataaattaatactataaatggttgagacgcaaaggtacgaaaaagcgttgatagtaggtgttctttatctatgaatttccatctagggcagaggcttgccgaggggtaggtgggtttgttactgcaacctgccttgcagtagttctgcaacagccatgcagcattactgcaacctgcattgcagtaacactgcaatgccgttgcagtattggactctctgtagttttgcgatttaatgaatactgaaggctccatctaccaatagcgcgtggccatctacgaagctcgcttgcgggctgcatagccaaagtacggcgttggcgatctcttccggtttgccgagccgccctgcgggaatgtcgcgcaccagctccttctccaaggaagggtcacgccgcattaagtcttccgccatcggcgtacggataacgcccggacatacggcattgatgcggatattctttgccgcatagtcgatagcggcggtacgtgtcagtccgataacggcatgcttacaggctatgtaggccgcttgccccggaaatcccgtgactccaccttgcgatgaggtgttgacgatggcgccgccgccttgtttcagcatttgcaggatctcataacgcatgcagttccagacacctttcaaatccacagccacggtacggtcgaattcatcgtcggtgatttccgccattgggcgttgcggtgtttgtatgcctgcgttgttaagagccgcatccagtcttccgtaggtagctacggtccagtcgatcatctcttttacggcttgcgtgtttgatacgtcgcaccgatatgctacggccttctgtccctcggctactaatttctctacttgttctcccggctcacggatgtctgccaatacggttatgtatccagccttggcgaaggcttcagcgcaagcgagtccgatacccatcgctgaaccggttactaaagctactttctcttccattgtctttgtcatgatcatttgatttacattttgttattatttatgtcgcgaagataaggagggagtggtatagaggctttgttatgtggttcaaatagctttgttgtgtgggccattataaatattatatatcctcggttggcggtacgccatacgctatcttatagattttcgagaaatgggaaaggttcttgaagcctacctcgaaacaaatctccgagaccttacgcccccccttacgtatcagcccatgtgcggcttcaaggcggcgtcggatgagccattcccggggcgagagagcgctacatttcttgaaatcacgtttaaatgtggagagactgcgtcccgtatagttggcgatttcttccatggaaatatcgttcatataattccgctccataaattccagtatgtctatcttccatggatcggtaaaatcgaagatagaggcatatagattcttgtcggtattgagcaacacatagacgccctcgaccatttttagttgaagcaattcgtctgtcggttggatcttggaattgaaataaggggtcatcgactcaaacaagcttacgatatcgggacggttggacggtagcttgtaaaggcttacctgatctcgcttggcgtctttagggagagtatttcgatctaatttgctgtaaaagtcgcgtaggaacttcatggtgaacatcaagaagatcgccttgaactgctcgccattccatgcttgtttcgtcatctgtacgctgaagtccttgcggatgaaagcgcattctcctttatgtaaccgggtgatttggcctttctcgtcgattaccatctctccggagtatacatacaccaacacatgcgaatgattccggtgcaggcagctctttccgccatcgaaatacatcgctaaaaataaatccgagtaacgcagtgtgttgatcccgtccatcgttctttaggaaaatgggcgacacgggaagatcgtgccgcccattatgaggattttaaagtaactgttaactgtccactaaatcgttaggccggcgtgataccttgctcttgcaatagtttcagcccgaggtctttcaacttgaacttctgtatctttccgcttccggtcatcgggaaggtatcgacgaagaagatgtatttcgggatcttatgccgggcgatctttccgcggcagaagtctttcacctcttcctccgtagccgtcacaccatcgtgaaggatgataaaggcacccacttcctctccatatttcttggaaggaacagcagctacttgcacgtctttcacgccggggaaatgatagaggaactcctccagctcacggggatagatattctcgcccccgcggataatcatgtccttgatacggccggtgatccgatagttgccgttctcgtctttcacgcctaagtcgccggaatgcaggaagccatccttgtcgatcgcctcattggtggcggcttcgtttttatagtaacctttcatgttattataaccgcggttacacatctcgccctgtacaccgacggggcattcctcgccagtctccggatcgataacccgtacctcggtaaattcgaactcatggcctacggtattataacgcacctcggccggatcttcgatacgggagtgggtcatacccggtgaggtctctgtcaatccatacacgctggttacacgcatatgcatcttctcgtccacggttttcatgagttcaaccgggcaaagagaacctgccataataccggtacgtaacgacgtgaggtcgaacatctcgaacatcgggtggttcagctcggcaatgaacatggtaggcacgccgtacacggccgtgcaacgctctttatgtatagaagctaataccaatagcggatcgaatttctcgaccatcacttgcgtacatccatgcgtcaatacgttcatggaagctaataccacaccaaagcaatgaaagagaggtacgcagcaacaaagcttatcgtcggcggtgaatttcatatgctcacccgtcaagaaaccgttgttggcgatgttgtagtgagtcaacatgacccctttcgggaagccggtcgtaccggaagtatattgcatattgacaacgtcgtggcaatttactctcgctttggcagcctctaacgtctcatccttgatattttgtccgaggagcaacatctcgggcgtattgtacatacccctgtatttctcctgtccgatatatactacatttctcaagcgtgggaaacgcttgcttttcaaatacccccgttgagaggtcttcaattccggcaacatggtatagaccatgtccacgtaacttccatcaaacacgccgtctgtgatacacatcgtatggatatcggcgttctcaaccagatattccagttcgctttgtttatagttggtgttgatcgtgaccagtacggcaccgatcttggctccggcatataagaaagtcagccaatccggtacgtttgtcgcccatacgccgacatgtgtgccatgagtgataccgatcgccagcatgcctttcgccatgtcgtccacacgcttgttgaattcgctccaagtgaaacgtaagtcacggtccgaataaacgatatattccttgtccggtgtagtctcggcccaatgttccagccattggccaagggttctgttatgtaattccataaaacgctggatttaataaggtgtatagacaactcctaggattcgggccttgttgtcggctgccgcatgtacatgatgcgccacgatggaatcataatagatgctatcgccttcctctaggatataggtgttctttccgtaattgatctctacgacgccattcaatacgtagataaactcctctccctcatgcgtggacaggatgaaatcctcgccttcctcggagggagcgatctcgatcaagaagggttccatatggcggccggacttatcttgcgagagcgagtggtaatccatatgcttgtgcccttgtgtcgcgttgttcgtgaacccgataccatcggcctcgctgtcctttttgcggcatacgaccgggcctagctccgcttggtcatccaagaatgtacccaaacgtacccctaatacccgtgctattttgataagaggggccaaagatggaaaatccaagttaccctcgatacgttcgatctgttcgatacctaacccggagcgttcggctacctcctcgatagagagttgtttcgattcccggatatttttaattttcgcgcctataattttgttgtttcccatgtgtatgatttgttatttatagtcctgtaatgtttgataatttgatactaaacggcgcaaatttacattaatattttattatatctaggattaagacaaataaaaagggcaatacccatttgggattgccctttttaatattttcgagtaagctttttcttactttctgataccaagttctttgatgatagcgcggtatctctcgatgtcagtcttgatcagatagtccaataaacgacgacgtttacctaccaacatcttcaatgatctttccgtagcgtaatctttgtgattcactttcaagtgctctgtcaagtgagagatacggaatgtgaacaatgcgatttggctctcagcagaacctgtgttagtagctgatttgccatacttttcaaataattcttgtttctttgctgaatctaaatacatgattctttttactttaataaattaatactatgttatctaagcggtcgcaaaggtaggcattcctttttgatttgcaatagattctgctatcttttttgtgttttgaagcatgaatgtcatatatatatcgtaaaaatatcgtatttttgcagccaataaattagtcttcaatgcaaaagatcagaaacattgcgattatcgcgcacgtagaccacggcaaaacgacgctcgtggataagatgttattagccggtaagcttttccgtgaaggacaggcagaaccggatcagttcatggataacaatgatctggaacgggaacgaggtatcacgattcttgccaagaacgtgtctatcaattataagggatataagatcaatattattgacactccgggccacgccgactttggtggcgaggtggagcgtgtcttgaatatggcggatggttgtttgctattggtagacgcctttgaggggcctatgccgcagactcgttttgttttgcaaaaagcgattcaactgggtttgaagccgatcgtggtaattaataaggtggataagccgaattgccgcccgtcggaagtgcaggaaatggtattcgacttgatgtttagtctggatgctaccgaggagcagcttgacttccctactatttatggttccgccaagcagggctggatgtccgaggattggaaggagccgaaagaggatatcgcggctgtgcttgatgcgatcatcaagtatatccccgaaccaaagatgttggagggtactccgcagatgttgattacttctttggattattctaagtatgtaggtcgtatcgccgtaggacgtgtacaccgtggcgagttgaaagagggccaagatgtcatgctttgtaagcgtgatggtagtatggtgaaatcgaggatcaaggaagtggatgtattcgagggcttgggacgtacgaaagttgattccgtgcagtccggggatatttgcgctattatcggtatcgatggtttcgagatcggtgagactatcgccgacgtgaacgagccggagccattgccaacgatcgctatcgacgagcctacgatgtctatgcttttcacgatcaacaattctccgttctttggtaaggatggtaagtttgttacttcccgtcatatttttgaccgtttgcagaaagaattggataagaacttggctttacgcgtagttcctactgattccgctgattcttggttggtatatggccgtggcgtgcttcacttgtctgtattgatcgagacgatgcgtcgtgagggatacgagttgcaggtaggtcagcctcaggttatcatcaaggagatcgatggtgagaaatgtgagccggtagagcaattgacggtgaatcttccggaggaatgctctagccgtattatcgatatggtaacgaagcgtaagggcgagatgaccatgatggaaagcaagaatggtcgtatgcacttagaattcacgattccttcccgtggtattatcggtttgaacaacgccgtattgaccgcctctgccggtgaggctatcatggcacaccgtttcttggaatatcaaccgtggaagggtgatatcgaacgacgtatgaatggttcgattatcgctatggagacaggtcaggctttcgcttatgccctgaataacttgcaatcccgcggacgtttcttcatcgccccgggcgaggaggtttacgctggacaggtggttggtgagcataccaaggacaatgacttggtggtaaatgttaccaaatccaagaagttgacgaatatgcgtgcctctggttcggacgacaaagtttccttggctcctcctatcgtattcagcctagaggatgcgcttgagtacatcaagggcgatgagtacgtagagatcaccccgaataatatgcgtatgcgtaagatcatcttggatgagacagagcgtaagcgccaaggtagataatatattcttctattaatagatacaaaaaacggcgggcctttaaaaagcccgccgttttttatatgatgttaggattttagagatccttcaatgagtgtgtatccttcattctttattttccggatctttcttctcttcatccggagtggtaaattgtatcactaacgattcatctttaggagtctcataccaatctccatgtgcctttcggtaatcttggtcaaaattataagcttcgtcgatgcttttattctctatacaccaacggaaaggttgattttccgaataaggaatatccaatacatatgggtatagatccgtattcttgacgtttttacttaccggtcccttcccgttatcaatgtaaggcatgatcagctgagtcgcactatatgttaatgtctttgtaatcccactttccggttccttgtcgaattttctcacattgacatatccattgacatcggagaaaaagggagttagtccattggcgtccttaaatccaaattggttgtggaatgtacagcctttagccagtaactgggcataaacatctgcggtactcttatcggtatatgctgtgatgctataatatatgacagcgtcattgaaatcgaaatcgccttggtttggataattatcttcgaacaagaggaatcctttcttgttcgtttgcgattctatgacgggaggggttaccggctctgccggctcgatggcaacgggattactttcgattagacaaagcatatcgttgtagtctccatcataggccctatagtttgggcagcgattttccattcccagtacatttccttcaaaatcaccttcttgaatgtggtgaatgaagccgtttgctacgtttttctctattttgaaagaggaattaccatattttaaggtatggcctacgtaattatgggagaatgtcccattatctggtactttattgttatccggcccatttaatgccggagtggagaactgtggacggtctgtgcctcgatatacgaagccgacgttgagccccttgtcgaatcttcccaagggtattcgggtatattctcctgcttgggcctttggctgttcttctttggagtagaatatataattatcgccttggttgatcgtattgaagtcagtgacttggatagcaccattagtttttccatagaaggtgcagtcatctaaagtaaggttctccatcttctcggagggatatgtatagaaccaaattttaccatgcatattactgttgcctttggacattcctccgtcgcttatataggttagccaaatatccgctttctcaaagctactggtaaaaacggtttccgtgatttttagatcagaacatctatataaatcttcgcttttcacattgtatgacttttccgggaagtatttgttattgatcagatgaaggacttcatcactgatcgcatttgtagcccgtaaactgcttttggttccgctaccgatcgtgatatcctttacatcgctctcaataagttccccatcccctcttaggatatagagtttctttacgtgtgtaggtacttccagagccatatggatcggagttttaccaattaaataaggatctttgactaaagagccttcctcataaggatattcataataaatagaatatagggtcccttcatgctgagaagatatgttaacctgtatgttctcgaaattctcgaactgggctatgtaatcttcttcttctttggtaggttcttgaggatataccgaggggtcttctccttgataaatgtcatgcttaacgcatgattccataaggaagagcagacaaaatacccacaccatttgtttccagatttgtgatctcataatttctttaccctatttgattaatatttacaacaactttattgaattttgcaaatctacggatttattttataaaaaagtcattgataatcaatatttattttgaagtgttgcaatattctgaaatataggcttgagtgggtggaatataaaaaaaccccatccaaaaggatgaggtctttttcttatttagaaagaatattttctaattattttactaaagctgagaagtcagagttagtcgcatatttagcgaactctaagtcgatagcagcttccttagccaagctcttgtcagcagcgatagcggccttcaagttgcttactacaccgttagcgtcgtttgtacgagcagcaacaacagccttcaagtaagaggtgatagcatcaggtttagcaacaccgttcaaagtctgagaagccttgctgtaatccttaaccaagatctgagccaaagcagcgttgttagtcttaacagaaccgaaagagttaacagccttagcatattcgccttgctctaagtaaagaacgccaagagcctcgctcaattcgtttacgccggcagcgttaccgaacaattgttgagctttagcttggtcacccttcgttaatgcgatcaaacctaagttcatgttagcggaagcgttattcttaacagagttagacttgttaaacatttgctcagccttagccaaatcaccagccttgaatgccatcataccgatgttgttccaagtgcggtagcagttaggatacaattcagaagcttttgtatagatagccatcttttcattgtcgttgttcgtcaatgtagcggcgtaaaggatttcctcgatattcaactcagaaggattgctcttagccaaagcgctgatctcgtcgtcagacttaccgatgatctcgatgttagcggtcaaacgagaacgacgtaattgcggaaggatagtctcagccaagtcagagtaaacagcggagatattcttgatttctttctctcttgtctcaggatcttggtacatagagatcacacgcaatactaagtctttatcttgcaagttagaagcagaaactaattccttgaagccttcccagtcttgagctgtgtaacgagcgtcaaccggagcgtcaactttcatcttcttcaattccttgttcaaatatttcgtagtgtttccttcacgattctcagccaacgtgttgttcaatttgaaaccaccatcaggagaagcgtaagcgctgatctcgatagctacattctggttcggagcctcgtctgcgttcttaacaagatctttccattctttgatagcgtcagaattcaattcttgagcgcgaaggttagcttgttggatcaagaacatgatgttagcgtcatgagcctctttgataatacgttggaatttatcagctgcgatagctgctgtagcagtagctgcgtctgccaattcggaagtagcgataacgccttcaccgatctttacgtccggcaatttaacagtcttgtttttgatcttcgcgtcgaaagtcaaatacaattctgattttttcatctcgggtttgtaagtgaaagaagacttcatagttacgttagcgccttctttttgagggattacttggttgttaccttttactttctcaccttggtaagtgtaagaagtgccccaagcttcgccaccctggtaacgcaataccggagttacagttacaacagctttcttgttgaaccatttagcggggaaagtcgcattgatcgttacaggaactttgcctccgatagcctctagcggctgcggctctgctttaatgtactgttctgccaacggtttcaacttgtttgaacaagaagaaagagttaaaatggctgccaatacgaagaatggcaataaaaactttttgttcataatcttgatgtaagtttaaaatgttactatgttaatatattcacttccaaattatcccttagccattatcgtgcaaaactaaagtatttttttgttatggatagcaaagaagcgataaaatctttttaattaatacttattaatgaatcctaggcttgttttatacataaaatatgggtagaattattgaaaaaatatggctgtgtacctcttgccattcttttcaatggatggtttcccagaactcttattgtatattttttgattaaaatataatcttttgtgtataatgctcctcgccataatgcacggttagaaagtagactccagatgttaattttaggaaatggagtgtagcttgcctgtccgtgatctctccgttttccgacacttttccttgtgccgagtgcaatgtataagtcgctttctccattccatccggcaaaacaaggtgtaccatgcctttctccggaccgagatgaatgagtacctgctcgttcgcctcgagcttttcgttgctgatggggttaccgtattgaatgacgggatcgataaacaaggaggtgctaaaacctgcttgcgtatattcggtagcttgtctccagccgtttttatcatgaacccaagccgtattccgggtcgttttgcctttgggcaaattgtaagcggagaaatacgtgttctccgggacgctcttgagcttatagccgatgtagaactttccgctgacgttcacgggcttggagaaatggatataactttcctgtgaccgatttagggatttagcggtctcaataaacgtatcgtccaatatcgatttattgctataggtgggttggaatgtctccgtatataataatgtagagggcttagagtcgccgctgtaaacggtaacttccacttccatctgtttgtaattcgctccggcaggcggtgttacgaaataagctccgtataaggtacccgcttcggctacttggtaagcttccgcatattcagtgatattggcggggttgttcccgaataaatacgctttttcagacccgggatagagcgtacattcggcgttttcttgattaccggagtcatagatgttgctcaaccggaaacaaggggctgatttatacggatcaagtccctcacaaaccttggtctcgtcattggacgggttcagccaatatttgagctgtctctcgggggtatcgattgcgtcccatggtttcatcaaagagaagaagtaatcatccttcgggctattctcgctggactgcccgccggataacgctccgataatctctccgtcggcattgaataaaggagatccggaggaaccgctggccgtataacctacttcccaagtcttgacatgccaatgagcgttcttgtaaaaaatcatgtttggatctgtcaaggtaaagggagccagatcctcatcggatatactgattcgctttaccgagtattggggatgttggatgcacgtatagggggcaggtcctacctcttgtgcgttccagcccgcgtaataaggcctgtaataaaccggaggtgtggcggtaagttccaacaaggccatgtctgccatttcattaaccgccttgaagtaagtggatgcggtagacatctcttccgttccccttaggatcgggtcgcagaaagggctgttgaagttgaaaaagcagacgatacttccggctattttctcataatcggggtttttcatcgtgaattgcttgttcaggcaatgggaggcggtgagtagataaggctttccgtcattgtccgtattatttatcagggtgcccgtgcaccctacgcttccgtctatgatcaggagaacgacgctttgcccccattgggcgtaatcgtttgtcccatcttgatagcaagctaacggtggaattttaccgatcagtgaggtgttgtctcccggttctaacccccgcaagctccggtagccatggttgacttccccgacggtcagtcttccttgaaaagaggcgttagccggttcttgatattctatgatcaggcgatccccttggataggagagaccggcaataggtttaactccgagttgtttaggtgattgaacgagcctaatatctgtgtctggtcctcattatataggaagagctgggcgccttcgggcagttcatattccgtgaagagcacgttgatggaaagggccccgggcgagtagatcccgagtctccatacacgtgtcccatccggcccggtgaaagttacgcccgagttgtaccgattgtaatccgttatgaatttataggcaaaacggaaaccgcttcttaggtcgctctcattcagcgagtcgatgcgtaactcctcttggacgtcgaacggaggcatttctttaaacatctgtccgtttgtacttcgcatgagcgatagcggaagcgggcggcctccgtggctaacctgcgctttcagatttccttgaaaaccgagcatcgttagcaggaatataatgtataaagaggtcaactttttcatatcgggcaaatataactatatttctttaccccatgatctatatatcaagttttttcgctaagtttgccaatcgaaaagtacggacaaacttaaataaaaccaatatataattaaattctaaagatatggcaacacctccgtttcactacgagccgatgttccaaaagggaccggacacaacagagtattatttgcttacaaaagattatgtttccgtttctgagtttgaaggaaaaccgatcttgaaagtcgctaaagaaggtttgaccgctatggctaacgccgctttccgcgacgtatcattcatgcttcgccgttctcacaacgagcaggtcgcaaagatcctaagcgatccggaagctacggacaacgataagtacgtggccttgacattccttcgcaacgccgaggtagcggctaaaggcgtacttcctttctgccaagataccggtacggctattatccacggcgagaagggccagcaggtctggaccggttactgtgatgaagaagcgctttccttaggtgtttacaagacctacacggaagagaaccttcgttactcccagaacgctccgctgaatatgtacgatgaggtaaatacgaaatgtaacttgccggcccagatcgatatcgaggctacggaaggcatggagtatgagttcctttgcgtgacaaaaggaggtggttccgccaataagacttatttataccaagagacaaaagcgatcttgaatccgggtacattggttcccttcctcgtagagaagatcaagacattgggtacggccgcttgtcctccgtatcatatagcgatcgtgattggcggtacttccgctgagaagaatttattgacggtgaagttggcttctacccgtttctatgatagcttgcctacgaccggtagcgagggtggccgtgctttccgcgacgtggagttggagaaagaggtattggccgccgcccagaatattggcttgggcgctcaattcggtggtaaatatctggcacatgatgttcgcatcatccgtttgcctcgccatggcgcttcttgcccggtaggtttgggtgtaagttgctccgcggaccgtaatattaaatgtaagatcaataaggaaggtatctggatcgagaagttggatagccatcccggcgaattgattccggaggaacttcgtcaagcgggtgagggcgacgctgtcaagatcaacttgaaccaaccgatggcggatatcttgaaggaattggataaatatccagtatctactcgtttgtcattgaacggaacgatcatcgtgggccgtgatatcgctcacgctaagttgaaggagcgtctggatcgtggcgaggatcttccccaatacatcaaggatcatcctatttattacgcgggcccggctaagactccggcaggtatggcttgtggctctatgggcccgacgaccgcgggtcgtatggactcatacgttgacttgttccagagccatggcggtagcatgatcatgttggcgaagggtaaccgtagccagcaagttacggacgcttgtaagaatcacggcggtttctacctaggatctatcggtggccctgcggctatcctggctcagaacaatatcaagagcatcgagtgcgtggaatatccggaattgggtatggaagcgatctggaagatcgaggtagagaacttccccgcatttatcttggtagataacaagggtaatgacttcttcaagcagatcaagcctcgttgctgattccttgatcggtaaagataaatgaaaagcggtatccggcggcaagctggataccgcttttttctaaaaaaaaagtcgtacgtgtttttttaataggttaatcccacgatccacagcggtagtttcttgccggtggcgaactccatattgtcagccaagatgaaggaatcggggagatccgctatttgcttgaatgttttatccgctcctcctacctcgaaggtgtaggcatggtctacgataaagtcaccttttgtttttccatattccacgttatgatttacggataactggttgacgacaaaagtttcccttgccgtcccgatctgtacgggagcggaagctatggcgtacaataggttgggattctgtaggtaaatcttatccggtttttgcatctttttgacagatagtaaatccgagtacaataacttgagcaattccgccttgtccaaattctgtaagtaattgatgacagagtttcgggaaagtccgatcattcccgctagtttcgtgatgtccagctcataaggaacagaggtagctaagatacccatcaaagcctttagcttccgtgtataggcaggatctacgccacacagcaacgggagttcctgctcaataatgagattgaccacattctcgatattaatataataatcttctctgttacccgtaaaaaaggggtaatacccttcgtggagatattcgttaaacatttgtacggggcgacatttctcatttatttcccggcaaatgtttcctggattttccagtatcgtttgtagggaatagacaggtatatcaatttgcttatagaacatgagaaattcccggaaggaaagtccgtacatattatatggtaggcaacgtctggaaagatcggcatccgcattcaatatattcaatagggaagaaccgctaaaaacaattcgtagagatggatacaggtcgtaggcctcttttatctctttactccaagtgggatatttatgtacttcatcaaggaataattgttttcctccttgcaaatagaaccgctcaatcagttcagatagggtgtgattactgaaatagatgctgtcgagcgtgcaataaagtacctccctgcttcccggctggaaattcagtttgatgtattgcaacatgagtgttgtttttccgacaccccttgatcctctgatggcgatcagaggattatcccagtgaatttggttcatgagttcccttatgatatgggtactcgtttgtgccagtaatcgttcttgtttaataaatagactatccatacgctgattgaatgaatgacaaatatacgatttattcaagatagatagcaaaaagtacatggatttgttaagggcaaaaagcaaatctggtgtttttttgttaagagtaaaaagcaaaacctgtaagtatccggtcgtagcgtactttgcgtattggctttcaaaagtttgtataaatatcaatgaaactattacactttaattttttacctttgttgcgtttaagtgataaaacagatttccaatgcctcgtatatacatcctcttgatgtcggtcttgatctcggctttttatgcttgcgatcatcgggggaagccttaccccgctaccctgtcacggatcgaatcccttgcggatacaaatccggaggaagcccgccctttgttggatcgattgcgggatagcctttcgtcctttgatgaggaacagcgtatgtattatgacttgctcgacttgaaggtcaatgataagatgtatgtccggcatacttctgattctttgatcaaacgaatcaccgctttctatgagacatatggcgatcgagacaaattactagagtcttattactatatgggccgtgtctaccgggatttgaatgatgccccggaagcgttgaagtatttccaaaaggcattggatgtggcgggggatacgagaaagtaccgattattgtccaatgtctattcgcagatggggatgctttatgattatcagaatgtatatgaagaggcgatccgtatgtatgagaaagcggctgagtataaattactgaaaggagatagtactagtttttctcttgtgctgagagatattgcccgagtatatgatatggtcgataagaatgacagtgcgcttctctattttcaaaaagcggcaattatagcgaatgaaacaggaaatagacatcgatattccggtatattgactgagctgggtgatctttaccgggaattggtaatgtatgataaagctttggaatgtttgtctgaatcattaaaagattccgtagaccggaatatgtatcctacttattcggttttggggaatacttatttagaactcaataaattggattctgccgattactatttaagaaagtgcctggatagtcctaacttacatgttagagacgctatttatgagtacttgtcgcttttgtatgagcgtcggttgaattatcgggaggctattcgctatgtccgtcttggccagcaagtgcaagattccatccgcaagataaccgattcggaggaaatccgtaaaatgacctctttatataattatcaaaagcgggaaactgagaatttacggctaaagggcgagaatgaccggatgcagattcgtatttaccggatattatccttgttcggattggggctttcgataaccttattgtttatatatagactgaaacggcagaaagagcggttggctaggcagtttgaggcgcttcagcgggaaaagcaagaacaatatgagagaagttttcaatatgtagaagcgaataacgcgaaattgaatgaattgggaaccttactatctaaagaccatgaagatacaaattcattgcttcatgtgcgaaaagaacttttgcaagtgaccaatgaacaaatacagttgcggcgtaccgagcgtgatttgttagagtcggatttaaggcattcggatatctatatgaaattccattccacgaatgaggcagatcagataatcagggaagaagattggaatgctttacggaaggagttagataagacatacaataattttacgaatcgtctatatcagttatattcgggaatgtcattgatagaactccggatttgttacttgataaagatatcagtcaaggtaactgatatggcaaaaatcttgggtcgctccaaaccctccgtatcctcatcccgtaaacggctttataaaaaaataaagggagaggatggaaccccgaatgaactggatgaattaatcgctggtctttagccttatacaactctgcgaacaaaaagcgaacaaaaagcgaacagtgttttagccccgaatccaaccttatcggatacttttgcagtcaaaaaatgaatgggatgaaaagaattttacttttgactttgttgagttgcgtgggcttgtgtacacaaatattgagtgtttttgcccaacaaggagagaaaagtgtcgggataaatgtgggttacggcacagcaagtagttttgagtcgtttcgcttaggtgctgagttcaattggaacgcaacggatcatattcgtttgtcgccttctttcgattgctattttgccagtagtacctcttatgtggttagtgcggatgtacattatttatttccgataaaaaacacatggcaggtttatcctttgctgggagtcacttatactcatttcatgactaatgaatttgggggaaatattggagctggtgtggaatatccgatttcctcgtctttttatgtaagtgccgaagggaaataccagcttacgaaggatttccagcaatttgctttggcggcaggtgtagcctataagttttaataggtcatttgatacatcgttcgacggagtataaagactaaattcgttgggagaacgagatataagaacttcttaggagatggtaacgtcctataaaataaaatcccggatagcgtttaatctacccgggattatatattaatgtataagaccttatcttagtttctgtactccctgcgaggcccgcaatcattacgatcttgatgaggaccacggtctccagacgcttccagccgatctcggaaatgtgaagcagatcatccttgcccgatataaactcaacgaacgtaccgtaaggcataagagaagcgttatccctcaaaaggcatgtttggcaacatgatcctaaattatcagtagtacttaccttgccaacgcagtatatcttctatgccacttgcagtatatatcccatggataagtaagtagtactgacttttccggcatgagaaaagcgtttcccttaggcgaacaaatagtttctcctagggaaaactaaagtttcgtaagcacaaaactaaggtttcctcatgaggaaacaaatgtttccatagcggaaaacttttgttttataccaagaaaaactataaatgtcaattaatcagttttttagatgatatatgaagcatgaccaaatagatagcttgccggctaagcaatgtctccgtcttcggtcgcttcttgaaaaagataggactaataatacggttggcgagtaggggacggtggtgttttgtgattgaaaagtagtaaatggttgtagatacgagccaatagtggtagatgctatttatctaccaccacccgataaataacttatgaccaattgattatagctatagttgtaggtgtggtagatgatttgataaaaaaatcccggatagtgtttaatctacccgggataatatataatgtataagaccttatcttagtctctgtactccctgcgaggtccgcgatcaccacgatcctgacgaggaccacggtctccacgatcttggcgaggtccacgctcacctctttctggtcttggcggacgttcctcgtaaccttccggtttcggaagcaataccttgcgggaaagtttgaacttgcctgttttcggatcgatatcaaccaacttgacagaaaccgtatcgccttccttcaagccggcttgctcaacggtctccagacgtttccaatcgatctcggaaatgtgaagcaaaccatccttacccggcatgaactcaacgaatgcaccataaggcatgatagaggaaatctttccttcataaacctctccgatctcaggaacagcgacgatagccttgatcgccttgacagccgcgtcgatcgtagccttattcgtgccggagatctcgatctttcctacgccgtctacctcatcgatagataccgtagctcccgttttctcttggataccttggatgatcttaccgcccgggccgattaccgcaccgatgaattccttaccgataatcatcgtctcgatacgaggtgcatgaggtttcaaatcctcacgagcttccggttgagcctccaagatcttgcccaagatatgcatacgaccctctttagcttgagccaaagcattctcaaggatctcgtaagacaaaccgtctaccttgatatccatctgagttgccgtgataccgtctttcgtacccgttaccttgaagtccatatcacccaagtgatcctcgtcgcctaagatatcagacaagatcgcgtagttcgtacccttgttctcggagatcaatcccatagcgataccggataccggtttcttcatcgggacacctgcgtctctcaacgccaaggtaccggcgcaaaccgtagccatagaagaagaaccgttagactccaagatatcggagattacacgtactacatacggatagttgtccgggatcatacgtttcagcgcacggtgagccaagttgccgtgtccgatctcacgacggcctacgccacgtgttgctttggcctcgcctgtggagaatggggggaagttataatgtaaaaggaaacgctcgtatccatggttcaatacgtcgtctatcattttctcatcagacttcgtacctaaagttaccgtagataaagactgagtctctccacgtgtaaagatagcggaaccgtgaggacccggcaggcaatctgtctcgatccagatcggacggatctcggtagtcttacgaccatccaaacgcttgccctcatcaaggatggcacggcgcatagcctctttctctacatcgtgatagtagcgaccgatcatttccagtttctcgtccgtcaactcctcctcggagaattgagccttgtattcttctacgattttctcgaatgcctcgctgcgttcgtgcttgccgctaccggatgtggctacggcgtaagccttggcgtaacatttgtcgtgtacgtccttgcgcaactcgtcatcgtttacctcgtggcaatattcgcgttttaccaatttgccgcaagcttcggataactccagctgagccttgcattgtaccttgatagcctcgtgagcgaccttgatagcctcaagcatctcagattcctgaacctcgttcatctcaccctcaaccatcatgatgttgtctatggtagcggcaaccatgatgtcgatatcagctttctccaattctgcggaagttgggttgacgatgtattttccatccgtacgagctacgcgaacctcagagatcggtccgttaaaaggaatatcagaaactgccaaagcggcggaagcggccaaacctgctaatgcgtccggcaaatcttcgccatcagcggagaacaatataatatttacatatacctcagcgtggtagttgtctgggaaaagaggacgcaacgcacggtctactaaacgagatgtgaggatttcataatcagaagcttttccttctctttttgtaaaacctccggggaaacgtccaaaagcggagtatttctctttgtattctacttgcaacggcatgaagtcaacacccgggttcgcgtctttagcggcacaaacagtggcgagcaacacggtgttgttcatacgaacggtaaccgctccgtccgcctgtttggccaatttcccggtttcgatggtaatggttcttccatcacctaactcgatcgtcttgttaattggattaagcataatcttttttcttatttttctatctgtcaaaaattggtgcaaatgtaatgaaagtttacctgtaattgcatgaaaatgaaaagaaataacagtcttaaagcactttttttgaaaaaagccttgaagaaatacggaataatagtgccacaattgtaaaataatgtatatttgcaccggattagtaatatagacaaactggaataatgaaacaaatatctacgaatttactagctgtgctgtgtgttatgttgcttttgttcacggcttgtaagaagaattctgattttacggtggaaggtgtagtgtccggcgcagacggccagatgatgtatctggagaatgtaggtgtgtcgacggtagagttgatggactccgtaaaactgacggcggccggtaaattcagctttacgaagcctcgtccggcattcccggatttttatcgcttgcgtctgaataaccaattgatcaacttctcggtagattctacggagacgatctcgttcgtggccgatgccgggactttcgctacttcttatagcgtggagggctcagagaattgcaaggcgatcaagaatattactttggctcaattagatgcgaaccaagcgatccatcgtttacggaaagaatctgagtccggtctgttggcggattccgtatattcccgccaggtgctcgaggccgccgaggcttataaggacgtggctcgtaagtatatttattccgccccgatgtccgctgccgcttactttgccttgttccagcaaattgacggcttgctgttcttcgatttgtatgacaagaacgactcgaaggcttatggcgccgtagccaccagcttcgatcactattatccggaaagccctcgtgctaagcatctgtataacttggctcttcaatcgataaaggtgattcgtagccagcgcccgatggacttggataaggtggagaagaaagaggttagtttcttggatatcgagttgccggatgtacatggggaaaacacgaaattgtcttctgtcgctacaggtaaggtggtgttgatcaacttcacggcctatatgtccgaatggtctcctgccttgaatatggaatttggcgatttatatacgaggtaccacgataagggcttggagatttaccagatctctttggatagtgatcttcacttctggaagaacgccgcttctaatttaccttggacttgcgtgcgtgatccacagtcggtttactctcagaccgcagcgttgtataacgtgaaacagcttccggcgatctttatcttggatcgcaagggaaacttggttaaacgggtggatgacgtgaagaaacttgaggctgacatcaagtccgtgttgtaaattgttcatgatttaatcatcagatttatatgttataaagcactttcgtaaacttgttcatcttagaaagataacctaactttgcggagtcttgaaatgataaaaaaggggagttccggccatatgacttggtcgggattcttttttattatgcgataatcaatcaatattaatataaagaataaggaggatttagtatggctgttagttatatgacaaaggacggctacgataagattttagctgaaatcaactatttggagaccgtgaagcgccctgaaatatcagcccagatcgctgaggcgagggataagggtgacttatccgagaacgctgagtacgatgccgccaaagaggctcaaggtatcatggaggctaagcttgcgcagttaaaaggtttgatctcaaacgcccgtctgatcgatgagagtcgtgtgaaaactgatgaggttcagattttgaacaaggtgaaaattaagaatacgaagaataacgctgtcatgacctacacgttggtatcggattcggaggctaacctaaaagaaggaaagatctccgtaagcacgccgatcgcccaaggtttgatgggaaagaaggtaggggatgtcgttgagatccgtgtgccttccggcttgatgacgtttgagattatggatatttcaatttaaaaacagaaagacgtatggcaactattttcagtagaatcgtggcgggtgagatccctagccacaaggttgcggaagacgatgagttttttgctttcctcgatatcaatccggtagccttggggcataccttggtaattcctaagaaggaggtcgattatatctttgatatcgatgatccgatgctgggacggatggtagctttcgctaaacgggtagctcgtgctcaagagaccgctatcgagtgtaagcgtgtaggattggctgtcatgggtttggaagtgccccatgcgcatatccatttgattcctatcacgaaggagtccgatatgtatttcggcgggaagaaattggctgtaagtcaagaagaattggccgagatcgccgctaagattagaaaagaattcaaataattgaatataattttttaattataaaaaattggttatatttgtacccgctgttttatgcgtgacaatatcatgcaaaggggacagcaaatcattaatatgattcattagtggtttttactcataaatttgttaaccttagaagaaaggcccctctgtgacagagcggccttctttttttaaacacacaataaacattataaactactaaattgatatcttcatcttacatcttcgaataggattaggggagccaaacggcatgcctgttccaaccgtgtacaccgttccagtaatcatgccagtcatatagcataccggattgatggatatatacgccacataatacaagggagataagccataaggctaataatatccatcttgcttgcgtcggtaagggacgtaccttgaacaattggcagcaaatcgcgtatatcagggagaatatggggatgccgatgaataagatcgtccctatgcatcccatgattgccattgacagcggtgctccgtttatcaagtccgctccgaacggagagagattatagatgaatccggctccacccatgagcaaagcgaatgttacgactaccagaatgaatacgactagtactagcggcggcaacaagaagattccggctaatatgatgaaaaacttcaagatgaacccgatgaccagaacgaaaacatccgccagcttttggaagaagttcctcggcttatccgagctgatgaagtcgttcacgttattgctgactttctcgaatccatctgtcacggtctttccgatattctccaccgtcacgctttgcccgcgcatctcgagtttctcggtcgccgtgcgtgccatcggtactatgatccacaacaagaagtaaagcggaaccgtgattccatagaagaacatcagaaggaaaagcacgatacgtacggcagtcgggtcccaatccatgtaggcggcgaaacctccggcgacacctcccagaatacggttgtccgggtcacgcatcaagcgtttcttggtcgtctgggcatgagtctcctgttgttgcgtccggtaattatcctcgtggtcggtgcttttctcttcctcctcgaaaatctcttccggcttacccatccgtttgatcacttcctctacctgctcgatcgtgatgacctcgtagcctaagcggacacgctcgttaagaagttccgagatacgcatctcgaaatcatccatgatctcatccgaaccctcttctttgcggaagtggatgcgcaggttagacagatatttgtctaataattggtatgcgtcttcgtcaatgtggaaaactgtgcctcccagattaacagtaagtgtcttcttcatcactctttcgttttaattgtttctgatgtggtttattgtatcatttagttcctgccatgaagcctccagctcgccgaggaatagttctcctttctcggtcagttggtaatacttgcgtggcggtccttgcgtagattctatccactgataacttaatagctcgctattttttagtcgggttaaaagaggatataaagtgccttccacaacgatcaacttcgcttcttgtaacttctgaatgatatcagaggtgtaagcgggttcctttttgagaagcaggaggatgcaatattccagcgtccctttcctcatttgtgattttacgttctctgcattcatctcttttaattttatgctacaaatgtatgtattacatatgtactatgcaatacatgctactatgaattattattatttaaccgaatacttgcacaaaaagagcaattatgtgtaaaaaaaggactgatgtcgtgtcttttagaagagaaaagcgtactttcgcggtatcaattcaaaataaggaattatgatttattatcatttcgccgagttaatacaccgtcaggcagagaaatatgggaaccgtacagcgttgaaacatagagataacgctacggggaaatggttgaagatttcttggagggagttttccgataaagttatgcttacggccaaggcgatggctgagttcgggataaaggtacaagagaatatcggggtttattcccagaatatgcctcagtgtttatatacggacttcggtgcgtatggtaaccgggtggtttccatcccgatgtatgcgacgaattctccgggacaaatcgagtacatcatcaatgacgctaagatccgcacgttgttcgtgggtgagcaattgcagtataataacgctttcaaggtacagaaggactctaagtatctggagcgtctggttgtctttgatccggcggtcaagatgaatccggaagataagacgtccatttattttgatgatttcttgcgcttgggggataatgcgcatgcggagagcacggtgaaaatacgtatgacggaagccgttccggaggatctggctaccattatatatacgtccggtacgacaggtgagtcgaaaggcgtaatgcttcctcattcttgctatctggaggcgatgcggatacatgatgtacgtctgcctctggtaaccgacaaggatctatccatgagtttcttgccaatgactcatatcttcgagaaggcttggtgttattattgtctccataaaggggttacgatcgctatcaaccaagacccgaaaatgatccagaagacattgccggaggttcatcctaccttgatgtgcaatgtgcctcgtttctgggagaaggtgtatgcgggcgtgcatgagaagatcaactccgcctctccggccatgaagaagattttcttggatgcgatcgagactgggcgaaggtataatctggagtataagaataaaggtattccggccccgtgtagtctgaagttgaagttccaattttacaataaaacggtttttaccttattgaagaaggtattgggtattgagcgtggacggtttttcccggtggcgggcgctccgttatcggacacgattaatgagttcttgcagtccgtgaatatcccgatcgcttatggttatggactgagcgagacgacggctacggtttgtttctacccggagatcggattccagtttggttctattggtgaggtaatgccgggagttcaagtgaaaatagatccggggaataacgagatcttggtgaaaggcaagaccgtgatgtccgggtattataataaaccggaggagacgaagaaggctttcaccgaggatggtttcttccgtaccggcgacgctggtcgtttggagggtaatacgttattctttacggaacgaatcaaggatttgtataagacttcaaacggaaaatatatcgccccgcaagcgatcgagatggtgatgagcggtgataattatatcgagcaaatcgctgttatcggcgatcaacgtaagttcgtgagcgccttgatcgtgccggcttatccattgttggagaagtatgccggggaaaaaggcatctcgttcgagagccgggaggagttggtgaagaacaaggatatcattcgtttcatcgaggctagggtagaggagcaccagaagaacttggcttcttacgagaagatcaagcgctttaccttgttgccggaacccttcatgatgggatgcgagctgacggatacgctaaagttgcgccgtccggtcgtattgcagaagtacgctaccgagatagaggcgatgtacgaggaataacgagtttgtcggctatcaactatttcttatcttcgcggtaaatttaaaaaagaaaagaacatatgatcacatcagaccaactacatgacgtgttggagcgcgataaggcgctgagggggtatctttgacatcgatagcaagaccattcagttagaagaggaggagctacgtacgcaagaccccggtttctgggaagacgccaaacgcgcggaagtccagatgaagaaagtaaaggagctaaagaaatggatcgagctttacggtgaggtacatgcggcggctgaggagctagagttggcttacgaatatgtaaaggaagagattatcaccgaggaagaggtggacgcggcttataagaaggcccttcatttactggaagacttggagttccgcaatatgcttcgtgacgaggccgatcaaatgagctgcgtgctcaagatcaactcgggtgccggtggtaccgagagccaagattgggcttccatgttgatgcgtatgtatcagcgttgggctgagaataacggttataagatctctatcgccaactatcaggaaggggatgaggccggtatcaagaccgtgaccttcaatattgagggcgattatgcctatggctatctaaagagcgagaatggcgtgcatcgtttggtacgtgtatctccttacaacgcccaaggtaaacgaatgacctctttcgcctccgtattcgtcaccccgttggtggatgatacgatcgaggtaaaggtagaggcggcggctatctcttgggatacgttccgttcgggcggcgccggaggacagaacgtgaacaaggtggaatccggagttcgcttgcgttatcagttcaaggacccgtatacaggcgaggaagaagagatcttgatcgagaataccgagactcgcgaccaacccaagaaccgtgagaacgctatgcgtcaattgcgttccatcctttacgataaggagttgcagcatcgtatggccgagcaggccaaggtggaggccggaaagaagaagatcgagtggggttcgcagatccgtagttacgtattcgatgaccgtcgcgtaaaagaccatcgtacgaactaccagacttccgacgtgaacggtgtgatggatggaaagatcgacgatttcatcaaagcatacttgatggagttcgccggagaagaaagctcggaaaaataagtttttccctttaacatttgcatatctcgataataaatcgtaatattgcacccgatttcagagcctagctctgaacaggtcctatagctcagttggttagagcacctgactcataatcagggagtccttggttcaagcccaagtgggaccacgatggatgatcgctaaataacgtaatattagttatttagcgattttttattgtacctgcatgaactaaaaaagaatatgagtgtttgaggtcacaatttgtgatctctttagagaaacgccgccgccctcgtgaatatggaatgaaaggcttggttgatcaggcccggatcgatacgggagtgtgtcgggaaggggatttgatgggagtaagcgaacgggaaatccagctcttccaatatcttgccggacgcttttcctaaagccttgatcaccccgccagtaggcataacgatatcttttttcaatgagatcgcccgaatacgatcgcaagcccgttggaagaacgactcccggtaatctcgtaacacatcctcacgtaccatggccttaaaggcttgctccagaaaatcattcttgaacgaggtgggaagcgtacggttctccaagaaatcatgccggaagtaatggcgtaccttggcgaacgcctccttgtccatgatatcacgggcgttgccatccatctcactgaagatggagccaccgcaaaacatgaataaacgggtgtccgtaaacatcttgtccggattcgctaataacaagacctgcgagagtaacgccccgatggaataagcgaataagttgatggacgtatcttccttgaacaaaggatgcttgccgttcttgatctcatgaaccaattgccacatattataaacggactctctgcccgaggcgtaaaagcgtaacgggttttgggatagccggctgctgagggctacgttggcgaaggtggagttcgtcacgttcgctacctcctccttgcgtttgcttacccaagggaggatcgcacggggattggcccataatcccggggtacggttcatatggaaagcgatcgggaacaggatgaccggcttaccggtcgtatgggtgaggtattccgcccatgtgaggtatttttcccaagtccgctcgttcaggccatgcaacaggataatcgcctcattattctttttacgtccagagggcgtgaatatggcatatgagaaagatttgttctcttggatacgatcgtcggtcatcggacagaatccggtgggggtaagtcccttctggaactcgtcgatctcgctggcgccacgggtctgggtgaagcgaaacgggatgatctccagatggctctcttccaattctgtctttttgtcataagagaaaagactgttcagttgcttagtacgaagtgaaatatccataatcctctgattttttactgcaaacaaacaatagaaaaacatctcttcaaaataaatggtttaaacgggctttgttggggacataaagtgttatttaggggtgaaatcttttatagaggggtgaatttcgtctgggaaaatgattacatttgttccaaaatagaggcaaaaagatgggaatgtgggatcaaaaaataccaagttacatatacggtaagcagaatatcgtgaggctgatcctgtggacggccttgttcgcgttggtgtttatcaacatctacaagccgtttagctccacctcttggtacaaggtctcggagtttaagttcttcgtattctctagcttgattatcttgacgggagtattggtggttgtcttgagccgtattattctgttccattgggggaagcggcatgctatcacggtccggacctatgcgatctggatcgtgctggagatattcttcatgtcgcttttctatacgatttatacgttggtactgaatccggaacgagaatatatggaagtttttaacgattcggcggtgaataccagtctggttttattgctcccttattccgtgctgcacctgtatttctcttataaagagaaagagcggcaattgcgattgttggaggagaaccagacagaagcggcggttcggcaaagcgttttctctttctatgacgagaagaacgagttgcgcctttccgtgaagcgaagtaacctgctgtatcttgaatcggcggataattacgtttgtatctggtatctgaataaggggcagctcacgaagtttatgcttcgcaactccttgaaggcgatcgaagagagcctcgctgatacgaatgtactccgttgccatcgttctttcatggtaaatttcgaccaagtgaaggtgatccgcagggagaaggagggcgtttatctggagctggggatcgagaaagtacccgatatcccgatctccaagacgtatagcgagaaggtaacccgctggttccagacctattcttcctagcgggctatttcaattcgatattattttctttcgcgtattgcgaggggctcatgttgaattgcttggagaaggcccggctgaaataggattgcgagttgaaaccaaccgcctcggcgatctcgtaaatcctcatatcgccttgaaggattaactcggcggctttctttagccggctgatcttgatcaactcgttgggcgttacgttcgacaggccgttgattttacggtaaagggtcggacggcttagattcatcaagtccgctatcatgtccacgtctaggttcacgtcgtttatatggctgtcgatgatatcgttcagtttcttcaagaacttctcgtccgccttcgtgtaagccatggatttgatattggcaatcggcgagttgaaataataggcacgcatattgctccggttgttcagcaggttcgtcacttgggaaagcaatagatccatggagaaaggtttgtcgatgtaagcgtccgcccccagctcaagcccttccatgcgagattgcaaggtgttcttagccgtcaggaggatgatcgggatatggctgaactccagattagtctttatctttttcaataaggtgaaaccatccatgacaggcatcatgatatcgctgatgattaattggatgccatattcctgaagacgggcaatcgcctcctcgccattaccggcggtgacaacattgtaatggacattgatctcttgaccgatgaaatggagcatttcggtgttatcttccaccacgagaaccgtcgggcgggattcttgggtgacatatttccgctcgctggcagggttggtcaggacctctgctttctcttcctctagttttaatgagttcggttggttcaccggcaaacgtaatctaaagatgataagcccagtcggagattcctccaacgtcaacgatccctcgtgcatctccgctaaagaacgggccaagggtagtccgagcccggtcccggatttatggatagaggagtcatcccggtagaaaggctcgaagatcttttcttttatctcctccgagatgggctttccatcgttcatgatatcgatcgtgaatcgctcgccatcttgcgtctcgaaccggacgatgatcttgcttcttgcgtatttaatagcgttcgataggaggttgctgagtatcttcgtgcaagcctccttatcgataaaggcgtagaaagatttcacgttacactcgataatcatttgcaatgcctcctgctccgccgtatcgtggaaacgctcaaaggtctcttgcatcaatgcgatgatgtccgtatgtatgaagtttagtttatatccctcgatttccgtcttcctgaaatccagtagttgattcaccagatccagtagccggttcgcgtttttatccacaatcgtcagataattctttgcgctgggagatagcttgatgtcccgtgttactttctccagaggacttttaattaaagttaggggcgtacgtatctcatgagcgatattgatgaagaaatcaatcttagcttgataaagctccttctccttttcattctcgaactcctgtattttctgctgtatattggccttattatgccgggaaatgataaagatcagcaacactacgcatccgatagcgataatcccatataggattaacgccttggtagagagccaccatgggggaaggatcgtaatctggaacatcgccggctcatcattccaaataccggacaggttcgtcgccttcaccttgaacgtataattaccgggcggtagttttgtgaaataaacccggttctcgcccaccacatgataccatttggaacttaacccttccatgcaataggcgtattgggtgaggttgggagcttggtagcttaatgatgtgtagtcgatgtagaatgtggactgattatgttctaaggtgattccttttttaaaagtgatagcctcttggtgtaagaagttatgatctggatcattataattaatctgtgatatatatactttcggttgaatggaaaattcttggatactattaggttggaagctaatcatcccctttagtgtcccaaaatataatttgtcattatctgtttttaaagaagagttataattgaattgatttgaagttaatccatgttcttttttgaagacttttattttatggtttttagggttgagtcttgcgaggccgttagccgtactgatccacatgtttccttttttatcttcttcaatacggtaaattacattgctaggtaagccatcttgcatatcgtatttggtcgtttgttgagtactacggtcataaattttgattccgtcaccagttgcgaaccataagttgttcttacgatcttcataaatattgtttattgttcggcttgtatttactgtatctaatttaaattctccgtgttgggaagtagcaggattataataatatagtcctttactcgatgttccagcccatattactccatcatgatcttcaaaaagagtttgtatcctacaattattaggaaattggcttaatttctcaaaaatgtctttttgagaattatattgatagacaccaagagcggtagctaccagcaaatcattgttttggagtttataaaggtatacgatgatgtcgtttttgtttgcataaggatttacggaaatcgtgtaatgtttgattattttctcagtacggatatccattaaatcaataccattagcgtgtgtccctatccataggtgattatctatagacgctaatccatgtatacaattttgtgaaaggcctttcatgtcattaaaagatgtatatgaatggtccttcatgtttagcttattcaatccagcgtcttctgtgccaatccatagattattatttttgtctatgcaaatatcgtgtataatatctccattgagcgttctttgtccaggaatattatagtgccttttgaattttgaataaggaggagagtagctgataccgccattatcagtacaaacccagatacctccttcttgatctttgtagagttctttgatagcattgctggataatgaatagaggtcacttttattttgctggatagacattatcgtatcattttgaatatcatataaatatatgccattaaaagtgccaatccatactttctcctttgtcatacgaatgatatttctagtataaagtggagattttttttgttgaggtaaaatatctttatatgtttttgtctgtatatcgattcgttttataccattatctttagttccaattaataatatattatctaaaggagaggcccatattgctgtcatatcatcgataggatgatttttatctagattcttgatatctaaggctatgaattcatttttgtcatcatctagaaaaacgacattaccattcgctgttgttgcccaaatttggtcttgaggagttatataaaaggaggtaataggatcacttcctttatacatataattaagatgcataccttgactttcattgtattttacgagtgagtacccattaagaatcatccagagatttccttgctggtcaaattgtagtgaataacagttgattcctttggtgaaatcaatgagtgtgaaggaatctgtttgatagtcatatttttgtagcccaaggttggtacttacccaaatttgtccggtgggacttttcgctaagtcaagaatataactgctcattaaagagcctttttctgaagagtagctcttgaatgtatagaattttttgctgtcaaatctattgagcccatctctggtaccaaaccacataaagccatagtcgtcttgtacgcaacatgtgacatgattattacttaatccgtcttccatgtcataggacttaaagtagaatggggttgcattcagttctactaagaagaataagcataatagcacaatttgaaacttcatgagctgttgatgttttccatgtttcgtttgcaagatatcaacttttttgatttttgcttttgtaaattagtttcattctttttcatatagtctcaatattgattttcagattccaatttcttctaattctagttggtttataggtgtgttgatacgaaaagtaacaattttgatatgattgaatggtttgtttttcaatatcaatgatacatttgcgacaagttctttaatgagataagactagtaacgttaaattaatactatgttaatatgaagaaacaaagtgtatttacaaccgattattactcaatattttatagataataagtcagaaatatggttgttatttttaattgcacattctaaaaggtgaagatttaacgcttttattgattattaactcaaaaaggacatcaacttgggtcgtttcttctcttttccttgctattcgtttccgatattccacttttgttttggtctatctcatatgtactgcaaaggtattgatttttgtttgatattgctccttgcttgctccttgtcgtagattaattttcacacaggaatttttgttctctttctataggggcttgaaacaatccatttattggaaacaattaaagacggagctggtttgccccagtgctttttaagaaacagggcaattattttatctccacaaaggctcttgttcccaattatgaggaaagcctaataaacgagttcttactgatgggtatttcgataaaagctgcttgaaatctgcaacaaaagtgttgcccatagaaatggagttaagccaatacaccacatagcagagttgcggataaagtgtttgttcacggaacgagaaatccgtaatccatgtgtttggcatacgcataggcatcattggcttgacaggaaagacccgatttgacagtcttgaatgatgggcgcagcaattacgaagtacgggtctgggtacggattaaaaggctaagtgattatttccagtcatttagcctttttaattatctaatttttccccacattttccccacagctgtctatttatatattttagaaacatatttttccgtaaagttatgtacctttgtcggcaaataaagatattctcgtcaaacaaatataaataatataaacatggaaaaaaacagaaaaaaacaaatcgtagttttgagtatagctttagtttgcattttcatcttggtattttcattgttccataaatcagcgacaaaagatagcgcaaatcctcctttaacaaatgttttgactgatagcatttctcaaattgtctcagcttgtcctggcgaaattggtgtggcggttattgttaataacagagatacggttaaggtcaataataagagtgtttatcctatgatgagtgtgtttaaggttcatcaggcattagctctttgtaatgactttgacaataaaggaatttcacttgataccttagtaaatataaatagggataaacttgacccaaagacttggagtcctatgctgaaagattattcagggccagtcatatcattgacagtgagagatttgctgcgttatactcttactcagagtgacaacaatgcaagcaaccttatgtttaaggatatggttaatgtcgctcaaacagatagttttatagccacactcattcctcgttcaagttttcagatagcttatacggaagaggaaatgtcggctgaccataacaaggcttactctaactatacatctcctcttggtgctgcaatgttgatgaatcgtttgtttactgaaggtcttatcgatgatgagaaacaaagtttcattaagaatacgttaaaagaatgcaaaacaggtgtagataggatagcagctccacttcttgataaagaaggggttgttatagcgcataagacaggttcaggttatgttaatgaaaatggtgttcttgcagctcacaatgatgttgcctatatatgtctgcctaataatatcagttataccttagcggtatttgttaaggatttcaagggaaatgaatcacaagcgtcacaatatgttgcgcatatatcagctgtagtatattctttattaatgcaaacttcagtaaaatcttaaactgcacttgctttgataattaatgataaacaatctaaaagcactctaatcgttatcggagtgcttttagattactaatcaaattgcttctattataatttgaatcctctactttttctttcttcctgttgcggcactcttgctccatatctaagcctgtgccattgctccctgaaccagtcggcaatcggcttcctgtttattgtcaggttcagcctgctttcatcgtcagggtcattttccacccttaaaatatcatcctttatatcaaagttccgcctgtgttgctcggaatagattttaccgctacatttcagggcttcttttttgactataagactttcagtcatttctttagagaatcccagcatggcacaaaacttttccatgcgcagcatttccctgaacatcggaaaccacctgaaagccttgtctatgattctggcgagccgtgacagttctttttctttcatgtcaagttcctgcctgtgcatttctctgagattgtggatttgcgtatcatgctgtttctgcatctgctgtacttggctctgcaatttttcaatattggtgttccgttttgaaacctcgtcttgcagtttttcgttggcacgttccagttctttcagttttccactcccgaaaagagaagcaactccactagttatggctgtcgctgccgtggtggctgtcttctttaacttgtcagtgcgtatttctgatttcacctgtttcagttcctgctcggcaagatttatctgttcttctttgtgccgtttggctgcatccatgcgttgcagttcagctttctgcttctcaatgataaagtcgttccgttccagatgctccttaccagtgacagcctttgactgcccgcgttccatcagcaggatgtcggatgcaagggtctgcatctgcatcatgtcatcgtcattgagctttcggctctttcctgtttcgtggttcatccagtcgaaaacgatatgggcatgatagttcggcttgaaccatctgtccccgactttgaagctttccctgtcttccgcttccggctgaccgttcagccaatgcccttcatccttgtgcaggaagatttgcagcggtgtgattccccagcgtctttgacactcctcaccgaatttacgcacgtctgccagtgtggtgtccgacctgacaagcagcactccttcacgtatgggggagcatcccgcaatcttgactattttaccgttcttgcctttgcgttcacgctccttttcctgcatgacacgtccggtcttttcctttaccatctgtctgatattgtcataatgcatccgcaaatccggactgccgaagtcgggatttatccactgttcgttatcggtggatagttcaggaacgacatagattctggactctccgatgtggcgcatgtattcggcagtcctcctgttgtgagcctcgctcgatgcgatgttgcagggcttgatatgtatgcttgattttgttgccatagatacttgttttttggtttgtactttattgtttgcttttccgctgtccgtaaacgcatggggttcttaggggtgcaacccataagcggagattgcaaagagagggtcactctttgctctgggttctcaggggagaaacgccctgagtgggtcattagggtaaaaccctaatcccctcgggagagcccacaactacgtaagcggagcgtgtagttatagtgggctatatcaatggcaagccattgtctgcaaactccagcctacggcttccgctctcctccgtcagggaggtttttcatcatcgttgccgattggagatgcaccgaccagcacaaggtctaaatcgtctatcagtttttgcaggacgggattcttctctatcatccgctggaggattctctcagcctcgaccaagtggttggctgtactcatcaccttgccctcccgtatctgaaagataatccaatcggctatgtcgatatgggcttctttttgtttcggggtggcattcctttcgatgatgtccgaaaccaccaccttacaaaagtacatgctctcggctcgctgtttccactcggcataagcatcggcatcgggaaagagaagcacggttcgccctgacagtacacggagtttctcttctctcatctgactcttaccacccgtagccagccatacataatcggggaagatagcagaaccgataacggcactcttctcggattccaccaagaccaccaccttgtcgggatgcgttttcaacaagtgttccccgaaaaggcattgggatagttgccaatcctctgccaacacacgctgctttttcaatatgctgtgtatccagttcactgccgatgtctgtcctcccttgatacggtgtccgtcttcgggattgtactgcatcacctttcccgtgcgtaccttgcccgtcctgtctatctgccaaaagataacagagccgtcacgggtagcccccaaacggtattcctccaacaaccgcttcaacacctctttcgccttgtcgccatagtaggaagtaaggagtgtgaagaggaaacggaagaaattgctacgctcgctttgcgacttctccacatagtgagggggaatatagccgatggctgtcggcttactttgctgcttcactttcttctgctctgctctttgcctgtcaaaagagaaatcattggtagttctgtgttcaggatgctcttgaaaatactctttcggagtgtagtgatacccacaaccgctttcgtggttacatctgccgaccgatggatgcaacggcacattattttcgtccacgtaatagacgaaagaatgcctgtctccgcatttggggcaggtatgccgtgttgccgttcctttatacttctgtaatgaataattgcccatagcttagtccgtttttgatggttgattgtcggctgtcccatcctgtcccattgtcccacactctaagggttgggacagtgggacacttgggacacctgcgtttttactctctttgctgcgctggatgatacggtttacggtggacttgccacaattcacctgtgaggctatctccctgacggacttgcccgattgggagagttgcagaatttggcaatccctttggcttgattcattgtcgcccaattttttcaagtgttccttttccgtggaatagcccctgaacacgaactgcaagaaagcatccaccttgtcaatctcgtaaacgattacattatccgcatcatgagagaacgtgccatagcgcactttaagctgcttcacatagcgaagccctccgtcttgggcactttttccaatggtgaacacgctgtcaaagaaattgtagagccgtttgcttccggcaaggtcgttggatgtgatgggacaatccaaagagcgtttgggcgtatgtgctaggacaaggatagagagcgcatatctctttttgagattgttcagctgaatcatcagccgtcctgcggcatcgcctttctccatggcgcaacacaggtaggtaagattgtcaatgatgaaaatcttgcagtcggtctgcacagccatctgttcaatgccgcctatgatagcttcctcaaagttggcatccaaaagctggttgcagtcaatagacacccgatagagtttgtcgggaaaggtgtagagctctccatgctcgttggtatagcggagctggaactgcttttcggacagttcaaagtccagatacagcacattgtcggttcgggcgatgcggtcggctatctgcacggcaaggatggacttgcccacgttggaatcggcaaacaagcaggagagttccccctcgtaccaaaagctgtcccacagcgcacggggcgtaggcaataacgatgcttcaagaatggtttggtttgccgtcttgatattcatcatgcctacactgtcgggcataccgttatgcgcttgggatgcttttgtgaggtcgccacgtatcaggttgatatagttcttatcctcttccatatcattcaccagttacgtgggttgggcttgcgacggtgggaagaggataaggacttgttcagttcctcgtctgacaacggtatgggattctttcgggcggtttccagccacttgtccagttcgtcacggtaaaggcaatagcgtttgccgggcttggtggcagggattgtcccttctgacagtttcatgtagagcgtacccttagggatacctaaatactctgctgcctcgtccacagacatgggcacgtgggtgtccaccgttttggcattgttcacactgcgctgctcggcgagcaggcttttcaggctcatcacttcgtctcgaagctgagcgacaacctcggggaggtcgttgaaggtaagaattgatttttccattcgcgtactcgtctcttttgtaagacttggcgcaaaggactgaaatgatatatccgtgaatatctccacgacacgtcattgcaaaataattcccgaataattaagcccagccataaatgacgggtaaaattactcgggaaacgatgtaaaacaggcggttatgagttaccggatggttgtcgttggtgtcgtgattatcctaattccgcacataatcctcgggatagtggaaatcaagtttgccgttttcgggttcatcaatgggaatttccgtctttaacggctctaccttgaaattcttgatggttgataagtctgtatcagcaaacgatttcgggaaaagggctttgatgaacttggcacggttatccccattgtagtatctcttgtacaggaaacgctcagagatattccatacgaagtgacggagtggaatgttgttgatgtctttggtaaacggtctttgtatgggcttcggggtataagtgttaagattcatccatttgtccacctcagtacagatgtggttcacggtttcttggtcggcaatgcgaggcaggtaataatggcaatactccatgaccatgcggatgcgctcttccttttcccgttgctctctgcttgcgtaattggcacggttcttttcgtgaagatccggggcgatagtaagctctatcggttgtgtttggataagtgtctcttcttttgtcggggatgattcgggtacaggctcagggactgatgtaggtccaggcacagatgtggcttcttcaagtgtattttgtgacagttcttcctgcacctctatggcttcggcaatcgtttctttcttgccgaacttgattttgtagatttcgtatgtatcaaagataagtgtctgaaaggagagatagagcaaccatcccaacaggttacagcatacgaatactatccacctgacaaagttgtcttggttgaagctgtccgctattaccagcgtggcaatggaagatattaggacgatggcgaagccgacaaagcccaagatgatgtatttgtccttgattgatgattccatatttcgttgagagattgaatgttcctgtattattttgtgcaaagttaatgctatttttcccaattactgcccgttatttgcggttagaacggtctttttcaatgtatttcacgaaatgtcatcatatcatactctgtttcatactctgaggggcttataaatggtggcatcaagccaaaaacatagaggggcgattatagccttgtagccataaccgcccctctgaatacctgtcaatgtgagacatttatgcctccttgcgcttcaaggttatcttgtccaccacctgacacatctgctgcgctgctatcttggaatagatttgtgtggtggtaatgttcttatgtccgagataggcttggatgacagccatgtccgttcccatttccacgtgcaggcttccgaagctgtggcgggtacagtgaaaggtgattttcttggttatccctgctgccgtgagccaccgttggagtggtccttgcagcatcttgtccttgaaatcctcaaagataagtccctcgccccgttctcccagcagtccataggcttcatcactgatggggttatgcactatttctttggttttctgcatacgggtggtaacgaacatcctgccgttggtgtatggttgtatctgctgccacgtgagctgtctgatgtcgctctttctcagtcccgtaagacaggcgaaaagaaaagcttttttcaagacctcctcctcacagggtgtttcggcaagccgtatcagttcctcttggctcaaatgctccctgatggtgggaatgcactcgatgcggtctaagaagccgtttgggttctcctttatcttcctgtcacggtaagcggtgtgcagcacggcacggaaagttgaccaatagcctgctgcggagttgatgtgcagcttttggttggtgtggatggattggggtgcatcaagcaggtattccatgaacttgcggcacaaatccacatccacctcctcaaaggtgcatttgccgttcacgaaccgctggaaatgcttgtatacgtgctgccacttgatattcttgcggtcagccagtcctttgaaataggcaaggaaatcgcccttcatcttggtcttgtcaaaaaagccgttgttttcattgaaaatggcttcgtagcgctggttgcgcaggatgaccgctttcttcatcatgcgtgcgttgaagtcccgttcctgctggtttgcaggtttggcgaagatgtaaattcctaaggcttcacgtgtaatcactctcatggtgacattgtcacggtagccgggatagtagtcaaggcatagtgaatactgtgtcccgttcttaatcttgcgcttacgcaaggtaactgttttgcatttactcataataattatgttttaattggttgtatacattttggagttgtatccatgtttccgatggcaaaggaacaacgtgaaatatccgtgaatacctccacgatacatcattttgaaataattttcgataatcccgatttttcacggttatttgttcctttcagccatgacacgctccacatctgagcgcaaaagcaggtttttcacacccacctttatcttttcgatgtgcttcaccttgacgatatggcagatgttggctgacgaaagaccatagatttgctgcacctgctcaacggtatagtagcgttcatcgttcacaaggtcagttctgcggagttcgttcaaatgtgatttggagtaataggtacgcccgtactctcttttagtgggtatcttatggcgataggtgtaggcacggagtgcggtcggcttcatgccgaacagttcctccacctcctcggtcagtagccagtcggtaatttcgctaatatcaactgccacaccgaaaaactcgtcaatatgcttcttgctgtaatagttctttcctgcgatacggcagatggggatatggttacgcttggcggaagtgtaaagccatgactgctttaccttaaaaagggacatcacctcctcgcccgaatagaagtccaacacttcttcgctttccttttcccttttttctcttttggcaggtaaggaagatgaagatgatttccttggtgtggaggtgttgccgggcaggatgcggtgatagggattgccctccaacatctgctcgatgtcggctctgcggatgaatgccatgcggttgctgatgcgtgaggctttcagcttgccgatggctacaagtttgtaaatgtactgtcgggaacagcccatgaggatggctgctttggaaaaggtgagatactcctgatgctgtatctccatcaagggttgggcgactttgaagaggttgttcttctgcatcactctggctcgtttggcttctgcctgacaagcctcactgcaatatctttgcataccgcttcgggttacaaaggacttgccgcaaaaactgcattttctggttgctttcataccgttttatcgtttaatggttcatttcttcaatcctatatctctgaaatggtaaacggatgtgaacggaagtcaaccattgtcgcttttctacacagtgtgactgtttccgcatatcggggcggttattgtcgcttgtcgtaaacggttgtaaacccttgtcaactgtctgcacggtgtgacaaaaaacaagccccgcaaattctccacgtcagaaatacgtctcaaaaatatgtggaaatttgggaagcgacaaatggcaaccgaaaagtgttaaattttagaatatgctggtaattaaagatttacactcggatatttctgattagttttggttgttctatggttataaatacagtaattgttttaatcagttttttatgtggagcgttctttgtaagtgctcaacaaggtaatcaacaacaaaggcaacaagagcggtggaaaccggaaagtacagaatggtatcatcctgtacctccaaaagtaacccctggagttggaacaagtgctccttctgatgcaatcatcctgtttgatggaaaagatcttacaaaatgggaagctgctgggaaggatggtggatctgcaaaatgggctataaaggatggaacgatggttgtagttcccggttctggctctatccgtacaaaagagtattttggtgattgccaattacacatagagtttaagaccccgataccaggtaaagataatactttacaaatgaaaggaaatagtggcattatgttacaaagtcgttatgaggtacaggtcctagattgtgaggataatcctacttacgtaaatggctgggttggtagtgtttataagcaaagtgctcctttagcaaatgcttttacaaagacgaatgaatggcaagtttatgatatatattggaaagctcctcgttttggaacaaatgatgagttggaatctcctgcgatgataacagtcgtcttgaatgggattgttgttcagaataattatgtgctgaaagggaataccccatatacagggttacctaaatatgtagctcatggccgtatgcctttaagtttacaagaccatggggtagaagttgctttccgaaatatttggattagagatttgtagaaagaagtttaaccttaaagaatgataacttatgactacacgtagaaatttcttgaaaaatacaacaatgctggcggcaggtttaggagtatctcctcttttgtcttcgtcacccttacgatcttatcagaaagaagaggtcataaatggaaaagtaagaattgccgtgattggagttggaatgggatgtcgagatttgcaaggagcgttgactgataatccatgggtacattgtgtcggtatgtgtgatgtgaataaagtcagacttgaagagcagcttgcacgttttaagaaagattttccagaacagacggtttctataaaagcttatactgattttcgggaggtactggccaataaagaaattgatggggttattattgccacgcccgaccattggcatccttatatttttgcagaagccttgaaggcgggaaaagctatttatgtagagaaacctgttggtaattcaatttctgagtgcaatgcgatgatggactttcagaaaaagtataaaggtgttgtgacaacgggattatggcaaacaagccaacgctatttcagggctgcgaatgagatattaaaatctggtgtgctaggggatgtttataaggtacaattatggctttgccaatctacaaatcctcgtccttctgttgaggattcagaggcaccatccactttggactatgatatgtggttaggaccggctccggaacgtccttttaataattcccgttttcgtggttggcgtggtttttgggattatggtggtggccaacagactgattggggggtgcattggattgattctgcttttgacgggttaaaagcacttggtttatgtgatagagaatacccagatgcggtcttttctattgcatataaagatccggcatcgtttaatgaaactccaagttgccaaacaagtattttccaatataagaatttccatattgaatgggctcaacaagttgcttacctttataatcggaatcaaggggtcgcttgggtcggaagtaaagccactctggtatgtaatcgtgaaggctatgagttgataccggagaaaacccgtgatggtatccttttggccgataaagctcaattggttggtaaatttgaagatgggggagtagaggctcatgcgactaattggtgtaaatgtattttgaataaatcgattgagacaaatagtccgatagaaaagggggcttttgctacaatattggctcatatggccaatatctcgtatcggacaggaactcgtgtggtatacgatcctcaaacaaggaaatttgtggacaatcctaaagcggatgcatacttgaacaaaacatatagaagcccttggcaatttccgaatataaaatgaatgaaattatgaaaagactattattgtttaccatttgcttgttgtgcgccagttctgtatatgctattgatatttcacggttagaacctgcttgctggtgggtagggatgaaaaatccggaattacagattatggtatatggcaagaatatcgcaagctctcaagtttatattgattatccgggggtaagagtcaaggaaattgttggagtcgagaaccctaattacttgttcctttatttggatatctccagagatgcctctcccggtacaatgaatttgatatttcaaaaagggaaagagaaagaaatccgggcctttgagttaaaggaaagaaataaaaaggttggagctgctggattttcacctgcggatgtgatgtacttgattactccagatcgttttgcaaatgcggatccatctaatgacaatctagatgatgtgaaaatagatcgttcgagagggggagctcgccatggaggtgatttacgtggtattattaataaattggattatatccgtgatttaggctttacgacaatttggttaaatcctgtattggaaaataggatgccgggaggttcttatcacggatacgctattactgatttttatcaggtagatcctcgttttggaacgaatgaagaatattgtgaattgatagataaggcccacgaaaaaggaatgaaagtcgtgatggatatgatttttaatcattgcggaagctctcattggtggttaaaagattttccttcctcggattggctgaataatcaagacaactttgttcaaacaaatcattttaaatggactcttatggatgttcacgctcctcagtcggagagagagatcttggtaaatggttggtttggtagaggtatgccagatttaaatcagaaaaataggcacttagcccgatatttgattcaaaatagcatttggtggattgaatactcacggattgatggtatccgtcaagatacacatccatatgcagattatgattttatggcaacttggtgtaaggaggtggaaaatgaatatccggatttcaatattgtgggagaagcttggtatccaagagggactgcttcggcttggtggcaaagagattctaaaatgaatgaatctaatagtaacttaaagacagtgatggattttgatttgacctttacttgccaaaaagcgtttggagatgcatgttctagccgtgaaggattcgaagcagggttatttaaaatttatgaagttatcgcacaggattttttattcccagatcctaataatgtactagtctttttggataatcatgatttaggacgctttatgcagaaaggagaatctgatttaagaaggtataaacaggctattgcttttttattaacaactcgagggattcctcagatttattatgggacagagattttaatgtctgggacaaaagcagaaggagatggtattatccgcactgattttcccggaggttgggcaggagatccaaaagatgctttcactcctgagggacgtacggatttgcagaatcaagcttgggattatatgagaaaattattgaattggagacagcgatgtgatgctgttaaagaaggtaagttgattcattatactcctgataaatcgggttgttacgtatatgctagggtaaaggataataaaacggtacttgttttaatgaatggaacagatcaaaaccagacattagatatgaatcgttttcatgaagtcgtaaaagattatagatctgggaaagatattataacagatacgatcgttgcgatagacacggcggttcatattccggctcgtggtgtttatattttagaacttgtctaactttaaatttaatatgtcatgagatgtaaaagtattagtgaatttattatgtgctttatgctttctttgttttcattgacagcgtttgcgcaaatcaagatcacaggaactgcttctgatgcggagacaggagagcctttatcttttatcaccatacagattaaaggtaccactgcgggtactacttccgatatggatggaaattattcaattgaggtacctaatagagatgccattttagtgtattcttatattggttatcgttcccaagagataaaggtcggaaatcagactcatattaatgttcgtctatcggaagatgtggagacattagatgaagtggtcgttgttggctatggagttcagaataagagagatgtgacaggatcgatcgctaaagttggaagtgaggaactaatgtctgttccaacaagctctttcgatgccgctttacaagggcgtgccgctggtgtacaagtaacccaaacatcgggtttggctggctctggtgcagccattcgagtgagaggtatcgcttctattaccgctggaggtgatccattgattgttgttgatggaatacccatcatgcaaaatgccggagatcgagtgggtgcagcacaagataatccaatgtcatctataaatgcgaatgatattgaaagtattgatatattgaaagatgcctcggcaacggctatttatggatccagaggtgcgaacggtgttgtcttaataacaactaaacgtggtaaatcaggaaaacctcaaataaattttagttctaaagttgcattttcaacaactaataggaaagttgatatgttggaaactaaagattatctggatatttataaagaagcattggaaaatgattataagtttaatccctctggtgcgacatatccttctactgtatcatcatatcccggtggttattcagaagaacaagctttattaaataatacggattggcaagatcttattacgagaacaggaatttctacctacaatgatttatcggtatcgtggggtaataagaaaatacagacttatttaggggtttctaatgtagaatataattcatatttggtgaatgatcatttcggaaggacgagcgtacgccttaatattgattataagcctataaacattttaaaaataggtggaaattttagtttctctcacacggatcatcgacccactccttcaagttgggatggtggttggggacgtgccataagtacggctttgccttatttcccagcctataattcggatggtagttattatgtttttcctaaatcaacaaatccggtgacggaggcaaatgagaaaagacgtagaatatttacccaacgtacaatggcaagtttatatgctgacttacagataatcaaaggattgtcattgcggctagaaggtaatatagattatcgagataatgagtctaattatttacgaacgaaagaattatcaacaaaaccgaatagtaatgtgacaaatcgttatgagacaaattggaatgcgaaagcactcttgaattatagcttgtcgattaatgaaaaacatcgttttcatttcttgttgggaacagaagcattgaaatctacacgagtatcgaattatacgaatgtcgtatttgagcaaggaaaagaagattggttatttaataatccggcttatgatgaaacgaataagacttttacgagctatcctaatcaagatttctcatttatatcctttttcggacgtataaattatacatttaaagaccgttatatgttcactggtactttccgtagagatggttcgtcacgatttggggagaataataaatttggtaatttccctgcggcttctattggttggatgatcacggaagaggactttttaaaagataacgaggttgtaagcttgttgaaattgaaaacaggttttggtattactggtaatgcggaaatccctaactatgcgcaatggggggcagttagcgtgaatacgaatcaattgtatgtaggggataattattggtatatcaattctttgaaaaacccagatttgaagtgggaaacaacctctacttttgatgtaggtttggagtatggtttcttaaaaaatcggatttcaggtgaaatcggattttataataagaattccaaagatctatttttgaatgtaagtgttccagcatctgtgggatatacggcattcttggcaaatatcggaaaagtcagaaatacgggtgtggagtttaatattaaatccgtgaatattacaaatagagattttacatggactactgattttaatatcagctataataagaataaggttttggatgttggtaatgcaggaccagacgcattaagtggagaaggtgatacacgtgtgttagtaggacagcctattggcgtaaactatttggttaaggttctacgtgttgatcctcaggatggtatgcctgtttatgaaatgcttgatgagaataagaaaccggttggtgaaactaaagaatataatgcggatagagatcgtcagcctgtaggccatccttattccgattttgtaggaggtttgaataatacgtttacatataagaactgggatttcggttttatgtttacattccaaataggcggcaatatttatgacgatggtgagaaatttcagatgaataatgttggcacttggaatctgaaaagtaatgttcttgatagatggcagaaacctggtgatgtgacagatgtacctcgggtaagtttaggaaaaagtggcattgaactggcgagaaatacaactgaatatctacatgatgcgggattcttacgtttaaaaaatgtaaatgtgggttatactttcaaaggtattagaatcaagaagtttaatataagggatattcgattatatgctcaagcaactaatttattgactttatttagtgaatactataataaatatagtggtgagcctgagattatgcgtgatgtcgattcagctcagaagaggaatttgagtttgaatgtgacttatttaacacctcctcaagctcgtacatatactatcggattaagtgttaacttttaaatgaataagattatgaaagtaaaatatatagcagtaatattactcagtacccaattagtctatacggcatgtgatgacatgggatttctacaaataaaaccagatagtttagaactgacagatgatcgtattaagacggtagatgatttggagaatttattgttgggtgcttataatggaatacgttcttcgggcttttggggaggccggacgttgcgtggttttgatgtgatcgcagatgatggtgtggcagatgtggctacttttgaatgggttcagatgagtgctcatacaatgaatttggtaaatgcggttggacgtgatacctggaccgcgacatataatgccataaatatggcgaatcaagttgcgtttagcgatttaggggaaagtatcttggcgagtgatcctcagaaagaagctcaatttaaggctgaggcatcttttattcgtgcattaggatattttcatttagtaagagcctttggccttccttatgcagaggagactaaggatatcgcagagatgggagttccccttcgtttaaggggggtgatggatcgtgctactgcatttgaggtcgtacaacgttcaacggtctctgaggtttattctcaaataatctcagatttggaatatgcgatcgaaaacttacctggagagaataaagtagagtctggtagagcgaccgttgatggcgcaaaagcgttattggcaaaagtctatttttataaacatgattttgggaatgcggctaaatatgcggaacaagttattaatactcagaagtatgatcttgatgaggatttgactgctaaattcggtagagcggaaaaaaagactgttacgcaagaaattgtagcgatgataccttctgcgtcattgattgaggattcttggggtggtttaagagattatcgtacgaatggattggctttacccacaagcaggccgtctaatgagttgattgctgcttatgaccaacaaaatgataatcgttttaaaacgttttttaaaaatatagacggttcatggtatactctgaagtttgattatgagtatatggatggtattattattggatataatgagttgttactactttatgccgagtctttagctaaatcgaatggaaatatgaatcaagctttgaatgctttgcaaaaaatagaaaaaagggcttatggcaaagctaatactacaactactgatagggcttcttttattaaagcagtacagaaggaacgtcgtttggaaatagctttacaaggtgagagattatttgaattgaagcgtatcaaacagtcggttcgtggtgaagcttgggattctcataaagtgatgtttcagattccggatgttgagcagaatggtaatcctgatgttaatatgaattaacttggctgtttaaaaagggtgagtttggctcaccctttatttgcttttacatctaaataattatagctatgattagaaaaataataatatttacttcatttctgttatttgtacttgggacagtggctgctcaaacgataaataaggtagagccgttgttttggtgggcaggaatgagaaatccagaattacagttgatggtatatggggatcatatttctgaatatcatcctgttataaatgaacctggtgtttatttaaaaagttgtgtaacggtagatagtcccaattatttaatattatatttagatttatcacaagctcattctggaacatttgatataacttttgtgaatggggaaaagaagttcgtatatgcttacgagctgaaagagcgcaaggagagtacagatgatatacaaggatatgattcttcggatgtgttgtatttaattatgccggaccgttttgctaatggtgaccaatcgaatgatcagatttctatgtcaacggaatatgtgatggatcgtagtaagcctggggctcgacatggaggtgatttgaaggggatcgaagatcatttggattattttgtggaccttggggtaacagctatatggttaaatcccgtgttggagaatgatgggaaaggaggttcttatcatggctatttctcaacggatatgtttcatgtggataggcgtctaggatcaaatgaagattaccttcgattgataaataaagcgcatcaaaagggattacgggttgttatggatatgatttttaatcatattggagcaaatcatccttgggtgctagatgtgccatctaaggattggtttaatgtaagtccttctaaaagggggaatcatgctaaggctattttctatgacaattatgcatcaacttatgattctgaagtaatgaaatatgcaggatttggaatagatttgaatcaagcaaatcctcatgttggtaaatatcttattcagaattctatatggtggattgagtatgctcggattgatgcgattaggcaagatacatatccatattccgattttgatatgatgcgtgagtggaatatccaaatcatgaatgaatatcctcagtttaatatagttggtgagatttggactaattatacgattggtacggcttggtggcaaaaagggtgtaaacttaattttggaaaagatacggaactgaagtctgtgatggattttactctgatgagtattgcaagtgatatctttaatgacaagtcttcaccggaagggcgattagataaaatctatgatcatttgtgttatgatttcgtgtatccagatattaaaaatgttttgcgttttttagataatcacgatactgataggtttttacgttcggagcctaaagacttagatggttataaacaaggggttgcctttttattaacaatccctggcactcctcaattatattatggacatgaattgttaatgtctgggacgaaaagtcgcccgggtggggatgggaatatacgtttagatgttccaggagggtggcctggagattctcagaattggtttacgagggaaggacgttccgacctacagaataaggcttgggattatttacagactttattgaagtggaggaagggcaataagatcatttctgaaggtaatatgaaacattatatgccacaattaggagtgtatgtatatgagcgttatctagagggtaaaagtgtcatggtcattattaatggagctaatcatgaagttgatcttccacttgcccgttataaggaatctttaaaagagggaatagaaggaaaggatataataacgaaacgaacgatcttatttaaggacagcttgaagctggcatctaaagaggtattggtcgttgagatgaattaagagattatgaaaataaacagacgacaattcgtaagaaacttaggattgggcacagcctcgttgagtatgggaagtttgatatcgacttcttcttgtgccccttctggggattcccgtgataaaagagggaaagtgagtgatgacgatcaattcctatttatcggtgacgatatcgccatcgcccagacagagtatgggaaggtgcagggatatctgctgaatcatgtatatacgttcttgggagttccttatggggctgatacgtcgggaaaaaatcgctttatgcctccccaaaagccagagccgtggacagatgtgagaccggcggttttttatgggaatacggcgccgcaacgtatggagaaccggtggcccaataattacggaacttttgccgatcattggaactactgggatgtgagtgaggattgcttatatttaaatgtatggacaccgggcattgcggatggtaagaaacgtcccgtattggtgtggctgcatggcggtggttttacaaatggtagtgggatcgagcaggatggatatcatggagagaatataagccgggaaggagatatcgtattctgttccattaatcatcggttggggccgattggcttctctgacttatctggtgttggtggagaagcgtataaggattccggaaacgtggggatgttagatattattgccgccttgcgatgggttcatgataatatcgccaatttcggtggagatcccgggaacgtaacggttatgggacaatccggaggaggttctaaggtctgtacagtagccgctatgccggcggcaaaaggtttgatccatagagccgtggctttaagtggatctacggtaggagcttccgatcaggtgatgacccggaaggtgggagaatatattttgagagaagcggggctgactgcttcccaactggataaattgcaaagaataccttggcgggaatatttggatatagcggatagggcttgtaaaaagtgctgggaagatcaagggattagcatgagacggacttttggccctgttgctgatgaccggaatattccggccggtgtattctactccggtgagagccatttggagtctcctgtcgtcccgatgatattctgtacgactttccatgaatggaacccgaacagggcggatgcggccttggaaaaaatcactcaagacggtgtgatcgagaaactgagaagtcaatatggtgataaagcggaatcgatcgtgaaggctttcgccaagaatttcccggataagactccgatggagctttgggcgatgattttgtcttcccgtcaacgagtggttgaggcggctaacgcaaaattaaagcaaggccagcctgtgtatgtagcttggtttggctggtgtccgcccttgtttaataaccgtatgcgtgcgttccattgctcggatatctgtttctggtttaaaaatacggatcggatgtttactcatacgggtggaggtaaggtacctcgtgcgttgtcagataagatgtctggcgctttgttgaatttcatgcggacaggagatccgaacggaggagagttacccgtttggccgaaatacacggaagaaaatggagaggtgatgatcttgaataatacgtgtgaggctcggaatgatccggaccgggaggcccgtaaatctttggaggtttaatttaaaacgagagtgttatgcttgagaaaaagatttcaagacgtaatatgcttcggactaccggtctggcggttttgggcagtacgttcgcaggcttggcttcttgcgctccgaagaaaaaagaggagccatcacccgaagcatcctcttcgaaacgtcctttccgtgtctgtctcaatgtctctacgatagcgggttataaacttcctgttcaaaaacagattgacttatgtgccgaggctggttttgagggaattgagttatggacccgtgatgtggatgcgttcgtaaagcaagggggaacttatgagacactcaggcgtcagctggaaggttccggacttttattggagaatatgatcggttttgcctcgtggtttgccgatgatccttcgaaacggaaggaagggctaaaccaaatgcggcatgatatggagatggtagcgggattgggcggtaaatttatcgccgctcctgctcaaggagttactcaactggatcgtacacggttgccggagtattccgaacgctatcgggcgatactggatttaggggatgagatgggtgtcactccgatattggaactatggggagccggggttctgaatcaattatcggataccatggcgatagcgatcgcctccgggcattcgcgggcttctgtcttattggatttctaccatttgtacagaggaggaaatagttttgatagtttacgcttgataaatggtaagatccttccggtttttcatatcaacgattatccggagttgcctcctcgtacggagttgagagattcggatcgggtgtttccgggagatggtatttgcccgtttaataaggtacttcctttgctatacgattccggtttccggggtgggttatccgtagagctttttaataagggatattgggaaaccatggatgtaaaggaggtcttaaagaagagttttgagaaaaccacacaggtaatcaatagttcgatgggataaaagtttgttgggatttaggaaagggactgcttcgaggtgttttaccttcgaggcggtcccttctgtttttatagtatcttctcttaaaaatcaattattttataatccgctgtgatataaaatgtagtatatttgcgtactctgttttggggtacgcaaaagctttgttcaccagaatgaataggcattatcctaaataaaccgttgttttgcggagaggtctaggggttgttatcatcgggaaagccgataataaaagatatacattataatgaacttacttctgagatatgtgggtcatggtataactataagtttgttagtatttataatgctggcgtttcatttgtctgcgttagcacggacaagtgaaaaacgtgtgctccgggttgcctttccgcaggtggtaggcatgagttggacggcggaggacggtagtcgtcatggtatgctcgtagactatctcaatgagattgccaaatataccggttgggaatacgagtatattgatacgaacgggcaagccatgttaaatgaatttatcgcaggtcagtatgaattgatgggtggaaactattatatacccggtttagagaaatattatgcttatccggattataatatgggatatagctgttccttgttgcttgctcgttctgatgatcgtactatccatagttatgatttggagagtatgaacgggaaaaccataggtgtatatgagaatgctaaagaaaatattcgccgcctcaaggagtttttggctatcaatggattagactgtaaattacgatattacagcttgaaagatatacagaagaacgacggggaattatatttttatttaatgaatggagagatagacttgctgttgagtggcattattcacaatcacgattctttacgggtaatcgttacctataattctcaaccctattatatcgtaaccaatccgggtaataaggaagtattggatggtttgaatatggctttggaacggatattggatgctaatccaaattttgcggcagagcgttatgccgctaactttcctgcccgacttgtaaatgtccaatttagtgaccgggacttggaatatgtcaagaaaaggaaaacgatcacggtagccgttccggagaattggtatcccttttattgtaaagaaacctcccagaagaaccatgtcggtatcatggtggatatattggataagatcaaggactttaccggtttggatttttcgtatgtgtatgcgaagaattatagtgatgcggtccatctggtacaacgagggaaagctgatatcttaggctttttcttgggagatgagaacgatgcggcccagctagggcttgcgctttcagcctcttatgtgagtgcgaacaatatcatagtacgcaataaagcctgtagttatcccgctccgggtttggttggtgctttggtggaaagtcagcgatttccaagtggcatatctgcggagaagattcggtcctatccgggcattaaggaggcattagccgctgtcaatagcggagaggctgattttatctatggattgtcctctaaaatggaacaggatatttcgcgttatcatttcaccaatcttgctcctgtgacattggtcaatgatcagagtgcgataagttttgcgttacctaccccagttgacccggatttattaaccgtactcaacaaggcgatcaataatctttctgagtccgagaggactgttatacgcaatcggaatctggaatctatcggcgtgaatgaattctctcttacggactttatatatgcgaatcccttacaatttatgtttatcgtgatgtttgtcctgtcggtgctatttacggcattactgctggctataggggcccggatgaaagcgaccgtgatacagggcaacctgaaacgggctgaggcggctaacttggcgaagagcgagtttctttcccggatgagtcatgagatccgtacgccgatgaacggaattgtaggtatgagtactatcgccatgcaaaacatagataataccgataagataaaggattgcctagagaaagtaatcatgtcttccaagcatcttctcgctctcattaacgacgtgctggatatgtcgaagatagaaagcggaaaagtggaacttcgacatgagagctttaatttccgggcattcttgcaggaccttgaaaatctgtatggcgagcaggccaagagtaaagggatcagctatgagacgatattggctagtgatctggaagtacagattataggagactccttgcgcttgaatcaagttctctccaacctgttatcgaatgcgctgaaatttacgccggccaagggaatgattaaacttcgggtatctaaaacaggtgaggatcaagagaatgtttaccttcgtttcgaggtaatcgatacgggatgtggtatagccgaggagaattatgataaaatcttcgaatcgttcgaacaggaaaatgtggatgttacttataaatatggaggtacaggattagggctttctatcgttaagcgtttcacagggttgatgggtggtggcatacatgtgacgagcgtgcaggggagtggcagtacattcaccgttgatctgcctttcggcaaaataaaggaatcgggtaagcccactcgtttttccgatattaatgggaggaatgaccttgcgaaggattgttatgctgttgattatgacttcaaaggtaaacggatcttattggttgaggacaatgagcttaaccgggagatagcggaggaattgatcggagttaccggtgcgtcggtggagagtgctgaggacggagtacaggccgtagagatgtttaaggagtctgccgaagggtattatgatttgatattgatggatgtgcagatgccgcatatggatggctatgaggctacccgatgtattcgtgcattagggcgttctgatgctcaaaaggttcctatcttcgctatgacagccaacgcattcgctgaggatgtgcagaaaagtagggaggccggtatgaacgctcatatatctaaaccattaaatatacgtgccgtgtataagcaaatgaaccggtaccttcaaggataaataaaagattgataaataataaaaaggggctgcctctggaaattaaactttcgaggcggtcccttctgcttttattagatattctttatttttccgtaattaccgagaattcaccgatacccgcttgctttttattatctacgatacgggttgcgaccaaacggatttggttacctttcgttatcgggaaatgtacgacttgctcgatcgggttagccttgatattggagaattcgccttcggccaccttctttccattaatatataattgatagttggagatatgaccgcttgcgtcacgtccttggttcggggtgtagcggaatccggatataggcatttctttcgctaattgtacgactaactcttgtttcccttgtggtaaatagtaggtcgtgtagccgtttccgtctaggattaggctggttttctcatctttcggtgatacgatcgtgtaatcacaagcaggaatatcgaacgtttgcgcggaaaccggactgactgtatcgaaagtcggatcataggcaatcgccttgacagttcctttttgagcgaaagcgaatggcgcctgataaagcggtgagtccttggtcggatctgaaccgtcggtggtataatgaacctcggagcctttatccccggcctgtatggttacctcgtcattgatattacgggcaatcgttggctcggtcaccaaggcgggggcaaggtatgcttccacgttattgatacaaagcggcccgcgggcgtccgtgaagttgatgcgtatcttctccgctttctcggtctggaaacggacaattcgtttatagccgacagttgtcgtagaatccacagtctgtgccggaatccatttacccccttgctcgagttcgatattgaacgagcgtactcgttgtcctaatgggatatattcttgtattaccaagcggtttacatcggtaggatgggttaacgtgaaagtcaatgaaccactggttactccatcgtccgtagcccaataggtatcccaatccccatctactgccttattgggactaaaattacgtcctcttttattgctcgcttgtacgtaacatcctttcaaaagattctccttaaagtcattttggatggtttgataccattgtacggcacgggcggagtctaccggacttatttttccgttcaacgctacggggaagttcaataggaaattggcgttatgcccgacgcttcggtaataaagatcgactaattttgccagagatttgacttggtgatcttcccgggagtgatagaaccatcccggacggatagatacatcgcattccccacctagccacatcggtccgttctcatctccccatacactctgttggaaagtaggcatggagggttccggggcgaagatgctccattgggtatcaccggcccaaccttcctcgttaccgatccagcggatatcgggtactgtccctccgaaaaccatgatgtccgggtggtgcgccttgatcgtgtctcgtgcccgctcatattgataataggtcttggcgtctatagcacgggtttcattcgtgccgccataccagccattgccaccgtttgccccatcaaaccagtattcgaacaacgggccatagttggagactaattcatgtaattgggcatggaatttctctacatatcccggttgtccgtagttctcactgtttctgtcccaaggggagagatagacaccgaatttcagcccgtgtttcttacaagcgtcggatagttcttttaccatatcccctttgccatctttccaaggagaattctttacgctatattcggttgtggcggtaggccatagacagaaaccatcgtgatgcttggtggttaagattacgcctttcaatccggcggctttgattgtttgcgcccattgatcgcaatccagatccgttggattgaatgtggaggcgggagtatttccgtaaccccattccagatcattgaacgtatttaatccgaaatggacaaaggcgtatgtttccatcttatgccattcaacttgtgccggcgtgggaacgggcaggataggggcgggcgctgtcgcttctttacaggagaagaaggaaaacaacccaagccccaataaaatagaggaactcaagtgcttcattatttgtttatatttagatgagacctcaaatatatgaaaaaaaacggcagatttttattctgtctttagatatctagataaaagataaagtcccctgtcttttagatgtctcctctggggaaattttcatgctagcatatgattgtttatcaattgtttgcagtgccagtttatttatcgcctttggcacggtcgtgccatcacagtggcaacgctgtgccatccgtgtggcagggccgtgccatcgtagtggcacagtattgccgctatgatggcaagggtaccggctatatcgtttacgtgagtagtcggtatttttgcgtgtgctatattataatgtacccgatatccgttgccgtaaaaaacttgaaaaataatgcccgataaatttggaccgtatgttttatagcattacttttgcacccgctttcgagagagaacggcgcttcagaaatgatggaaacgtggaggtatccttgggtaggggatgaggttggctgggccaagcgataatttccaaccgcccggagatcggcttgagaaaaaaacttgaaaatttttcaccgaaaaatttggaggttaagaaaaagtccttacctttgcagccgcaatcgagaaacgatagcgacaagagttctttgagagatttacataattcaacaagtagtacaagtataggaaaattaattttccggattgataccgtcaaagaagtatgactttggactacaataacggattccggagcgaggatataaaaacaatttaaacaacgaagagtttgatcctggctcaggatgaacgctagcgacaggcttaacacatgcaagtcgaggggcagcacaggtagcaataccgggtggcgaccggcgcacgggtgagtaacgcgtatgcaacttgcctatcagagggggataacccggcgaaagtcggactaataccgcatgaagcagggatcccgcatgggaatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcatagatatcacgcagaaccccgattgcgaaggcagcctgccaagccattactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtaaagctgaggactctggtgggactgccagcgtaagctgcgaggaaggcggggatgacgtcaaatcagcacggcccttacatccggggcgacacacgtgttacaatggcgtggacaaagggaggccacctggtgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgcgaggatcggcctagggtaaaactggtgactggggctaagtcgtaacaaggtagccgtaccggaaggtgcggctggaacacctcctttctggagcttcaggattccgtaccgaggtcatacgaggtattgatcccttgtgctgctgttgagattatgtttatatatagatcttacagaccgggaggccggtcggagagaaaaagatgacgctgggacgtaagtcttggcaaagttgacagtcctatagctcagttggttagagcgctacactgataatgtagaggtcggcagttcaactctgcctgggactactccgaatgagggggattagctcagctggctagagcatctgccttgcacgcagagggtcaacggttcgaatccgttattctccacagtttattgagagggataggcatcagccaatcccgtcccgacgacagtcgggctcagtaagaaggatctttgacatgttggacatcaaaaagaagaaacaagtagagcgagcttaagatatatcaacccgtgcgtcaagtacgaggtgggagaaagtaagcaagggcagacggtggatgccttggctctcggaggcgacgaaggacgtgataagctgcgaaaagcccgggggaggcgcaaatagcccttgatcccgggatatccgaatggggcaacccggcaggctgaaggcctgccatcccgtaagggaggcgaacgtggggaactgaaacatctaagtacccataggaggagaaaataaacaatgattccgtaagtagtggcgagcgaacacggaagagcccaaacccatgtcgtctaggcgacacgggggttgtaggaccacgacgtggcaagatagagtcaagtggaacgccttggaaaaggcggtcatagagggtgaaaaccccgtacacgactgacgattgaagcctagtggcatcctgagtagcgcggggcacgagaaatcttgcgtgaaacagcggggcccatcccgtaaggctaaatactcccgagagaccgatagcgaaccagtaccgtgagggaaaggtgaaaagaaccccgagcaggggagtgaaatagaccctgaacccgtctgcctacaagcggtcggagcgtcgtaatgacgtgacggcgtgccttttgcataatgaacctacgagttaccttccccggcaaggttaagtacctaaggtacggagccgaagcgaaagcgagtctgaacagggcgccaagtcggggggggtagacgcgaaaccgagtgatctacccttggccaggttgaaggttgggtaacaccaactggaggaccggatgggtaagcgttgaaaagctttccaatgagctgagggtaggggtgaaaggctaatcaaactcggagatagctcgtactccccgaaatgcatttaggtgcagcctctttatagtatatcgtgaggtagagcgactgattggatgcgagggcttcaccgcctatcaagtccagataaactccgaatgcgcgatatatatttacagggagtgagggcgcgggtgctaaggtccgtgtccgagaggagaagaatccagaccaccggctaaggcccccaaatgatcgttaagttgaactaacgaggtcggatcgcagagacagctaggatgttggcttggaagcagccattcatttaaagagtgcgtaacagctcactagtcgagcgatctggcgtggataataatcgggcataaacgatctgccgaagccgtggatgtcgcaagacatggtaggggagcattccatgcggcgtcgaagatgagggatgacccttgttggagcgcatggaaaagcaaatgtaggtatgagtaacgataaggggggcgagaaacccccccgccgaaagaccaaggtttcctgatcaacgctaatcggatcagggtgagtcgggacctaaggcaaagccgaacggcgccgccgatggaagaatgggttaatattcccatactgcctcatggagtgacgtggagacggagaagtgacagtcctgccggctgacggaatagccggttgaagggtgtaggtgtcgatcgcggtaggcaaatccgccgcgagagccgaacctgacagtatacggagcgcttgcgcaacgtaatatggacgtaaccatgctcccaagaaaatccgctaaacttatccatgcggcacccgtaccgtaaacggacacacgtggtcgggttgagaatactgaggcgctcgagtgattcacggttaaggaactaggcaaattgaccctgtaacttcgggataaagggtcctcgtcgtaaggcgaggcgcagagaataggtccaggcaactgtttaacaaaaacacatggctgtgctaaatggaaacatgatgtatacagcctgacacctgcccggtgccggaaggttaagaggagatgtcatccgcgaggagaagcgttgaattgaagccccggtaaacggcggccgtaactataacggtcctaaggtagcgaaattccttgtcgggtaagttccgacctgcacgaatggtgtaatgatctggacactgtctcaaccgtgagctcggtgaaattgtagtatcggtgaagatgccgattacccgcgatgggacgaaaagaccccgtgaacctttactatagctttacattgagtttgggcagacgatgtgtaggataggccggaggcattgaagcaggtacgccagtatttgtggagccgacgttgaaatacggcccttcggttgtttgagttctaactcctagttaggaggacactgtatggtgggtagtttgactggggtggtcgcctccaaaagcgtaacggaggcttctaaaggtgccctcagaccgattggtaaccggtcgcagagtgtaatggcataagggcgcttgactgggagacatacaagtcgatcaggtaggaaactagagcatagtgatccggtggttccgcatggaagggccatcgctcaaaggataaaaggtactccggggataacaggctgatcattcccaagagctcatatcgacggaatggtttggcacctcgatgtcggctcgtcacatcctggggctggagaaggtcccaagggttgggctgttcgcccattaaagtggcacgcgagctgggttcagaacgtcgtgagacagttcggtctctatctatcgtgggcgcaggagatttgcgaggctctgacactagtacgagaggaccgtgtcggacgtaccactggtttaccggttgtcccgccaggggcaccgccgggtatctaagtacggatcggataagtgctgaaagcatctaagtacgaagccggcctcaagattagatctccctcaagggtggttatagacgatgaccttgataggccacaggtgtaagggcggcgacgtccgagccgagtggtactaatagcccgggactttcctcacagtgaaggttgatatattttaagacgataaggcgaagctggtctcttcggattgatgtccggtcaaaatcttgataatgatattaaggtggctatagcacgagggatccacctcttcccattccgaacagagaagttaagcctcgtcacgccgatggtactgcgtaacagtggaagagtaggtagccgccgtcttaggtgaaaggagtcagtcgaaagattggctcctttttttggtatatacactagccgtttaattttcaatgatgtctgcctcttattgctagcttccatttacaacagtcatttagatgtaacatgacatgtctggtaggaggcattaataaaataccagctatatcttttttagcccagaaatcaagcaaccaaatcgaatcttcatgatttgtgataccaccttcttctaatatccggcttatcctttgagttgggattttgcgacgtatatcatcgggagataaggttcggatgatttctctgctttttcgtcctacttcattcctgtattctaagagttcttgaatacgtagacttttgcttagctgaataatctggttatcagataaggcatttcctgtgtctctgataggggaattcattcgggtttgccagtcttcattgaagatctgcttttccccgttaactaatatattcatggtcagatcctcaattctgctgatatgccataatacccaagcgatggtttcatctttcgctgtaggcataatggcatattcatcctctcttaaatctccgactagctcatcgacctcgtttctctcattaccagacaccacagagaggtgtaattttccatgaatctcaagaaagagctccttggtttgctctattaattccggtttacggataatgcggtttagttctttatgtgattcgcttaatccggctccaaagtatttcattttggggattattggtagcgtacggctgtcccggcggcggtaaccatcagcatgcttccgcttcctcctacggtctcataatctagatctacggcgattacagcgtttgcgcccattcgtgccgcatgatcgctcatttctttcaaggccgtttctttcgcttcgcgtaagacactctcgtaagaacctgcacgtcctccgacaatatcccggatgcctgcgaagaaatctttgaatacattcgctccgatgatcgtttcaccggatacgattccgaagtactgggtaatttcttttccttcgatcgtgttagttgttgtgagtaacatagcttttcaatttaatcgtttgagggcaaatataagataaagggcgaaccagtgtactgattcgccctttgtttttatgtttctttatatgaatttattttaccggttgatcggtcatgataaactcaagcttacctccatttatgatatcggagtggctgatgaaaggagtctctaggactttaccgtttagcttgacttctttaacgtatttattggcgggattattgttggtcgccacgatctcgaaaataccgccttttacgtgcatagaagccttatttaccatcggacggcccaatgtgtaaaccggaatacccggacttacctgatagaaacctagggcgctcatgacataccaagcagacatctgtccgcaatcctcattaccgatgataccatccggttcgttcgtgtagaaattctgcatgatataatctaaatacccttgccctttccatggagaatctgtccagttataaagataggccatatggtggctcggctcgtttccatgagcgtattggccgatcaagccggtaatatctccggaggcttccgccccgtcaatctgggaagaggtggtgaataaggtgtctaaacgtgtttccagctctttcttgccaccgatagcggcgatgaagttatccatatcatgtggtgcgaagaaactccattggaaggcattcccttcggtatagtcgcttttcatatgcgaagaatagcgagggttgaatggagtacggaaagaaccgtcgcccattaccggacgcatcatcttcgtctcgggatctaaatagcgtttgtagtattcggctttcttggcatactcattcgccaactccatgttgcctgccttcttggcgatttgggagatacaccaatcctcgtatgccatctccaatccccacgatacggattcgggaacagagtcggcggggacgaaaccatatttctccttatagtaagggtgcatcgtgatcagatccaactcacgggttcctttgaacttctcggcaagatcctcacggtaaacggaagaacgtgcgccggcttccgcccacgtgctcatatcaccttccgctaaatctttcgctacaagatcggcgaggaccgagacggccggatatcctaccatacaacctgtataactagaggctaaaggccatttgggtaatattccaccttctttataaccttgcacgagtaccttaccccaatctgtcgctaagtccggattaatgattgtcattaacggatgaagcgcacggaacgtattccacaaggagaatacggaataatttacgtaacccggttcggcggtatgcactttcttgtccatgcccagataacgcccgtccacgtcttgataagcgaagggggcgatcatggtatggtagagcgccgtatagaaattgaccatgactttcggatctgcctcgatctggatcaagtttaacgcctcgttccaaatatgcgttgattcctcacgggtcttatcgaaatcccatccgggcaattctgcctcgagattcttctcggcgccttccggatcgactacggataaggctacttttacataaagcggttgtgccttttcagagaatttgtaatggaacttcaaatcttccgccgtattcaggcgcaaaaacaaggagtccttacgtaatttcccgtccatgtattggtatacggtctcgatcggttccgagaaagtaatccgataggacatggagtggaaatgtgcccaaccttgtgtcttcacggtaccttccaccgtggagtcgtttacaagtaaatattggttaccgatcagcttatgtccccagttcggttgaaggatatgccctaagtcaagcaggacacgacgttctttgggattgtcgtatgtatatttatggaaacctacacgatccgtagaagtcaattccacgttgatgccaaagttatccaagcgtacggcataataccccggtgtcgctttctcagtgtctttcttgaaggtagctaccggtttgatggaatctccaccggagaaaggtaataaagctacgtcacccagatcgccgatacccgtaccggaaaggtgcgtgtggctgaatccatagatatggttgtcgtcataatggtaaccgctgctcgcgtcccatcctaagatatgggtatccgggcttagttgtaccatcgcgtacggacgggtagctccggggaatgtgtgtccatggaacccggttccgatgaatgggtttacatacctcacctcgtcttgtagtcgcggcgactccggcgcttgcttgcatcctaccagcaggcaggcaagagcggcctgaaaaaataagatcgttcttttcactgttattattgatttagtttgtaataagcgaattatcaatcatctgtcacaaagataatggctttgggggaatattggaaatttccttttaaaatctgcaacctttttcgggcttggctcgtcttatagataaaaaagtatgggaacaaacgaatttacgacaaagatattgccgctgaagaataaccttttccgggttgttttccggattaccggagacgtggagcagtctgagcagatcgttcaggaagccctgcttaaggtttgggaagaccgggatagctggattgtcattgagaacttaccttcctattgcatgatggtagcgcgtaatctggcattgagggaaacctattccggagataaggaaaggatggagcggtatgcggtaaggtaatctgcttatggatcgtgtatggactatcaacgaataaataagttgctggataaatattgggaatgcgccacatccgtggaggaagaacgggaattacgccggtttttctcctcagcggtgatacctcccgacttattgccctataaggcttggttcgtatctcatgaggccgaggcattgcctcccttggggaaagattttgatgctcgtatattggaacagatctcggaagatcgaaaattaatcactacatttggaacgttatttaaatctattactcatttaattcataagattatgggaacgaacatgaagaaagtctttaccacccttttatgccttttgttttgtatcgcgatctcggcgcaggataaagccgctgatctcagtaagctcgtaggcgattggtccttctctgcccccgacgctccgtatggatatcaagatggcagtttgcagataaagcaagagaacggcaagttgaccgctaaagtgaatatacaaggtagtaccttggagataaacgatatcaaggcgaaaggagatacctataccagttctttttatgtggatggaacgcctgtagatttaactatgacccagaaaggaaataagttagagggaatggccgacgccggaggtatgcagattcccgtgaaattcaagaaaacgaagaagtagccgctttgtggtactgtgagtttctgttaacttcgcggcaaaaactacaaagggatgtttacagtaatcggaatcatgttctgcggcattgccgtcgggtatttctttcgtaaagtagaattgctgcaaaagatcggtaagcctatttcttatacgattcttcttcttttgttcctgctgggaatttcggtaggggctaatgagtctatcgtgaataatcttacgacgttgggcgggcaagccttgttgattgcttcggccggtacgttggggagcgtcttggcggcgtggggagtttatcatttcttttttaaggaaaggagccggggatgaaagggagtttgatcgtcgtgggcttctttgccttggggtgcttgctgggatggagcggttatctgcccggggtcattatcgagaatgatataacggtttatgtactttacctcttgatgtttcaagtagggattagcataggaagcgataagaaactgaaagagattttgtcgagcatacggccgaaactcttattggtgcctctggctactattatcgggacgttgagcttctcggccttgatcagccttgctcttaccaaatggagcgtgttcgattgtttggcggtcggaagcggtttcgcctattattcattatcctccatcttgataacagagctaaaagaaccgacgctgggggctcaattggcggcggagttaggaacgatcgccttgatcgctaatattatccgtgagatattcgccttgctgggcgctccgttgttcgttagatatttcggaaggctatctccgatctgcgcgggaggagctactacgatggatacgacattgccgatcatcacccgttattgcggaaaggatttggtctttgtctctatctttcacgggatcttggtggacttcacggttccgtttttcgtttctttcttctgttcgatgtgagtgaaagaggcttccgagatctcggaaaccaccttgcaaggttgaaaagtcatttccgaggcctcggaaggcattttgcaaggttgaaaagtcgtttccgaggtctcggaaggcattttacaaggttgaaaagtcgtttctgaggcctcggaaggcattttacaaggttgaaaagtcatttctgaggcctcggaaggcattttacaaggttgaaaagtcatttccgaggcctagaaaagctattttacagtttgcagcatcacttctaccgctctttttaattgcgtgtcctcgccggagagctgcgcctcgggagtattgtacacctcgacatccggttgcaattgttggttttccagataattgccttgcatatctttcacgcctacttgcgggataccgaacaccaaggtcggatcgatttgcgtttcccaccatacggctgtcatggttcccggaaccggggcgccgatcagcttgccgatacctaaggtcttataaacccaagggaaaccatgagcgttcgaataattatcctcgcacatcaagacacaggacggtttggtccacttattgtaaggatcgctaccgatgtattgtccgcgaggctcgaagcgctgatactccttgccgctcaataaggtagccagatcatcatgcaaccagccacctccgttatggcgggtatccacgatcacggctttcttattccggcaccggcctaataaagcggaatagacctcacggaaactctcgctgttcatacctctcacatgtacgtacccgatttgcccgttcgataatttatctacggtttcttggcaattctcgatccatcttttataaaggaggttcgattgctctccgttaccgatcgctttcacctgttcctcgaaacgctgtttactggtaggatcatagacagaaagcattactttcttaccgactttaccgcttagcagtggataataatcggcgtctttctttatcggtgttccgtctatcttctcgatgatacagcctttctttatctggctgtcggccaatgtcagcgggcccttggcgatgatttcctcgatcttcaatccgtcgcccgtgtatgcgttatcgaagaaagcgcctaagctggcggtttccggcccggttagtcccggattgtaacgagcgcccgtatgggagccgttcaactcgcccaatagctcggaaagcatctcttggaaatcaaaattgttgttgatatgcggaaggaaacgggcgtaagcggtctcataccctttccaatccatgccccggagtgtcggatcatagaacttatccaagacttgacgccaagcgtggtggaagatataagcacgctcctctgccggacgataagcgaactcggccttgaaagcgatcggtttttccttgctatccttcaactctatctttttcagtttaccgccggcggtaagatagaggttctctactttcttatcggcgaatagagtgcctcgaccgacattcttgagcagtaatttagtggacttttccttcaagtcgtgttcccataaatcaaagcctttctcgaaagcggcgcaataatatagtttatctcctttcggggcgagtacggcgtctcccaatgaggatgaattagcggtcaggcgaataatccggtccttgcggttctccaaatcaaacttcaagggggctacaggcttatccttatcctcttttttcttatcggaatctttatcggatgtcttatcctcgtccttatctttgttttcatccgcttctaccaaggccagttcttctttactgaggcggaatttatcgtaagcctcaccgtcgaagaacatgatgtacacatcccgctcagcaccccagctaccgtggctgcggaaaccggcacggtcggaggaccagatcatggccttaccgtctaatacccatttcgcgtcgccatccgaataaccgctttccgtcaggttcgttacctcgccgctaccgtccgctttcacgagggcgatatccgtattgttccatcctccgacggagatgtaatctaccaagaaccacttgctgtctggcgaccattggaaatgctggtctccatcgctatacgaatagaggtatttcccgtccaatacggtgcggacctgcttggtctttcggttgataacacgtaaggtggtgcggttctcaaggaaagccacctcgttaccatccggagagtataagggttggaacgaggtttgtccggagacgacaagaggctcctctttcaattccggggcgtacgtgaattgcttatcttcgtcacgtgtaagtttactttcgtagattccccatgttccttcccgttcggcggaatataccaatgaacgtccgtcggggctgaaatctatattgcgctcttgttgcggcgtgttcgtgatttgacgagtcgtctcgtattcaatagaagttacgtaaacatcgccacgagtgataaacgctacctcttttccattcggggagacggcgatatccgtagctccatcggtcagaagacgatggattacgtcgttctcgatcttatccgcgacgatctggatattcaccttggcaggtttctggccttccttaacggtatagatctcgccgtcgtaactatagcatagagtcccggtattatcggaggtaaggaaacgcacggggtgggtggtatgcgtcgtgatttgtttctcgctgttgcctgccaaatctttcttgaagatgttaaagcttcctttctcctcgcttaggtaatagaaagacgccccatccgcggcccatacaggattacgatcctcaccgccaaaagtggttactttctggaaagagcgatcttttccaagcgtacataaccagatatcacgggtgatagaagattgatgatgcttgcgccaagggtcctcgtaacctttgtagtcattgtataataatttactgccatctttgctgagggctatattttccatgtataacgaagaatataaatccggccttcctccgtccgtgcttatctcatagacttgcataaagcgggtgccggggaattggatatccttggcgtcttgcaatacgttggctagatacaagatgtgtccgttgtccttaaaggtagtgggatattcgtttgtggagtgggtggtgagccgcttaggttcccctccctccttgttcatgagaaatatatcgaagttgccgctacggttggaggcgaaggctattctctgtccgtcgggcgaccagaccggacgggtatcatgcgccggatgtgttgtcaactgccgggcttttcctccggaagaagggaccgtgtagatatccccttggtaagaaaatgcgatcgtctgcccgtccggggagatcgcgcagtaacgcatccataacggactgtcgtctgcttgcgccgccgccgataaaaataacgccagcgcaggaatcatcaagtttttcatgtgtactctattttagatttacaaatgtaatcgattttcgatatttattaggagaaataattgcgtagattaaatttttaaatatttttgcatatgaactttaaaaccgccaagatgatgactaaatatagggtgtgtatgacttttatgtccattttattattgctatttcattttgtgtttctgttttcttgtggaaagctaccggaaaaaacatttgctttttctgataacctgcggattgactctttggaacatatggctatggattcgatttaccggaatcctcgatatgctcattccgcattggatgaagctttaagtctaactaaagatagcgataaatattataaattacttgcggttaaaagccagatttattttgcaaatagtgtatatgattccgggtttgttttacatcggtcaattatagattattgcgaccgtgtaccgatgtctcccaagatacatggactcttagggacgctgaaaaatacggttggcaattattattcatttttggataaaacggattcggccctcctttgctattccgaggcgtatcaagagatccggcagagtgagatggagcataaaatcccggatatttatatcaatatagcggatatatatgcccggaaaggagcttacgatcagcgagcccgctactttcgccaagctcttttcgtgagtgattcattgggtattatggatcggatgtcctttcctatttattttggtttgggcgagacgtatatggaattgagggactttgacttatccgatcacttttaccgtttggcggagaaagaactggattctcgtaacttgagcgagaaattcaccttttgcaatagccggggaaattactattattacaaggaagaatacgcggaggcgcttccttggttcttgaaagcccgtgaggtggtacgtcctactcatatggatttctataccaacgtatgcgagatcaatttaggggagatctatctatgtatggatcagttggattccgctcgtttttatctggaaaaagggtttaggtacttccatacctataataataagacggccttgtaccatttgacaaccctgaaggcttcgctagccttaaaagaggggaactccgggctggcttatcaattgttgaggagttacacggatacggtaggcatagatcccaagatggtagtgatccgtaataagaacttgcagaattacttcgctaccacgggcgattttaggcgtgcttatgagtatcaaacgaagaatagcgtcattgagaacaatattcgtagcgaacgaacccagatgcgtgtcgccgagatcgatatgcgttataggcaagatacgactttgctcaagcgggaggctattattaaacaacaggccggccggatggaatacttggaaatgagccgttgggtttggatcttgctttttgcgatcttgtcgatcgtcagcggcatggcttattactttatgaaacgtaaacggcatgcccagtggttaagccatatcgatcaggtgacgaagctgaagatggagagtatccgcaaccgtgtatcccctcattttatattcaacgttttgaaccgggaaatcagcacggaagaggagggaagcctccgccgcacgcaactttccgggctggtggagttgttgcggagtagcttggagatctcggaaaagctcagtattacgctgcgggaggagctgaggttcgtgcgtacgtatctgaacctgcaaacgcaagcgctggggccggacttccatttggcatggaatatcgatccttcccttgacacggacgcgatctatctcccggccatgctgatccagattcccgtagagaatgccgtgaaacatggcttgtgtgcgattgagggcgagaagcgattatccgttttcgtggagcgcgacgggaaaggcatccatatccgtatagaggataatggacccgggtatcgtccgtttacgaatgcgggacatacgaacggtacggggatgggaacgaaagtcctttaccgtacgatcctattgttgaataggagaaataaagagaagatcacctattcggtccaaagcaaggagaaggggatggggagcggaacaatcgtcagtttctttattccgttggattttaattacgctttctaggtatcgtgaatgtacgaaagtaatccgggccgtttcctccggatagtggatggaagcggcccggatcgaattgaatcgaatcggttgattcgggttatagtcgctcaatgtcttcaacagaaagtccggagcattgggcgataagttcggagtcaagtccttgctccttcatctttcgggctatctggagtttttcctcttgacggcctttctcgatccctttctgcattcctttttcaatcccttccgtttgtgcgtaatcgatggtcgcataccaatcccgataattctttaggttttcctcgtagatcgcacgttctttttcgctgagtgagttgacgttcgccacgtccagcaagcgaaggaaggtctcctgttcctccttgaagggagattgttcaaataggttcatattcttcaatgtataaatccaacgttcgaaggagctcttgcactcctccttgcttaaactgaataacgggaacgatatgtagatctgcttcatcttgatctcattgaacacctttcccgtcctctcgttagcgaggacaacatctgtacggaagtctgtgaactccggcaacttgaaattcaagaaatagactccgtagatgggtagcaaccgatattgccattgcttgccgatttgtccttgccgggccaccatgcgacaaagataataaaaacctctgttaaagaaatagtgctggggacaattctgcatctctaggatgaacttggccccggacacgtcctcgcagagcaggtcgaatatgatggtacggttctcgacggtctcgggcttgatctccttgtcgaggtaggtgatgtccttgatctgtcgttcgccggctagggcggcgttaaggaacttgatggtaacttgcttgtcttggaagacagccttaaatccagcatcagtcatgatgtctacgtattgtgccatagttaaatggttttaggtgattactgctccaaaggtaaggtttattttcgtatcgcacatcctgtttattgtatatttcttaaaaagcagattcatggtagtcagctttactatttatagaaagtacgattagtattaatagtagtgcaaaatactatggatagtaatcggctcccattttgatcaattcttattatacgctgattatcagaaatataaataacaatctttaaatattaggcttattgtactttttaagagatcaaatttggtatggttgacttattcttttcacgtataaagataacattaaataatagactaagccgctagcataaagttctccaagtgaataactaatcacttctcaactcgtaagcttatggcttgacaagccttggattatacgtttgtagtatttgcaatgattgcatgtgaatgtttgtattttgtatttattatgcggttatggatggataccatatattaatgtacatgcgtacattatataatagatagaaacggctagtctaaacgatcgattcttttagtcatttgcaaaggtacgcgtttcttcgatacttgcaacccttccagacgatttttttatcgcttattctctttcttatcaataggataggttatccttcacgaaacaagcgattccttcaacgaacctcccgtttcgacgctcaaaaaacgcaagatttagacgatcgtttagactagtcgttttcgagaaaaacaagggtgctaaacggcgggatggactttaattaacactattattaatattaaattttgaatttatgaacaagaagttttctactcttttggcaggtatggcactgttaagtgttatgtctgttaatgcacagactacaccaagtcgagtagacccggaaactgtattgggtcaagaatggcgtttaggcggtttgaaggagggagctaattctggtctttatcagttgaaggtcatggatggcactactcctgcttatcttgcgatggagctaaatcgtggaacaggtgattatgaactacgtgtttatagtgcaagcgaagctaaaaataatttagaggctacattgtggtgtgtttctgtctctaattataatcaaggtcaagctcctatttatgacttccagaataaattgtctggaactatgttggatttgacaatggctggccatgagaagactgagaatggtacgaatggtgcttggaaacctgttttaggtggtgagatcgcaggttgggcattctctcgctcatacaaggatttggaagaaaagagacctttgtattcttatttctcaacggactcaattgttggtttgaaagcggatcctactaccggagctgttaaggttgccaagtggggtgctaatcaaatagatgccacttcaaacgccgctgatgtgactaactttgctttggttggcgcagcacaaatcgcattgagcgaagatcaagtaaatacgaagttgggtcttcttcaagataacaaggctggagtacaattgactttcactccggacgtgaaaggtactagcttaaagaatccgttcaatgagcagaagtttatcgcagaggataaagataataacaaatggcttttcatcaagcaaaaggataaagaagcttatttgaaagttgatacggcttatacgaatgagacaggtacaaagttcttagcttacggttggacagagaaagcaaaggataaagctgatgcttacagttctattagctctgaattacgtgctcaacatcagttcaaattcatctattctccgagtggcgatagcttatacatctatgtaaaaaaagttacttggaataatgatggcaagtattggaatacgcacgttacggctactccagttaacgagcatgagttctggcgtgtctctttgcaagacttgattaaagatgaaacttgtattttgacagttgatccggaggaccagaacactcatatttctttgggtcttagcggatgtgaggaaaagggttcttccaagacttccgttgatgatggtgtttatttcatcaagaataaacaaggacagtatttagcttctcctatctatgagaatggtactatccgttggacaaccgtgaatgaggatgagcagagtgttgctcatatgccagcttatcaatgggttgtattgaagaaaaatacaagtaatgataaagtgaaggctgtgtctccggttactatctctaaccgtgaattcgcagataaagttataaatgcggattttgatggtgatggccagatggagtcatataagactgctgtttattctactgttcagttaagaaaggcagagggtggttcttatatgtttgtatatggagataaacttacagcggagtatggctctgtcggtatagattctttgttcttcgagaaagttccggcagcttctatttctgatccgtatttaggttacagaaagttggagaaagattctttgttggttaacaaatatacgtttaactattggcatccttatgctacggataaatacatcgctaaatctacagactctacgttgactgtgttggatggaaaagatgctttcgtaattgatacattgactgagcgttggaaaaataactcaaagatatttgcgactgtagatatcccttacggttataaggttagcgatgatgtggctaagaatcgtattaaaggcttgaagactctagtgagaactgcttatgaggtttcttataaagatggtaaaggtgaacttaatgaatggaaagttaataaggaagataagtttaatgtaggttctagtgctactggtcatcagcaatcttatacgacttattatgcattcttcaaagaaaacaactatatcagtggaaagcactattatgcgattgttaatgctgcatatgataattattctaatgctacaaaatatgtattaggttatcagaaagctggagtatccgattatgacggtgccgctacattgaagaatcaagtattaggcgagactcgtacttctgctttcgctatcgaaccggacaacactccgctttaccgtcgtttcagttctcttgaacttgaaggtaatgaaggtgacaaggccgatactttacgttttatcgagaaataccgtaaagaatacttgcaggttgagaataataagaacttcatgaaagaaggtattgacttcttaggtatttatactccggataagactgaggatggtttgtcattcatcgttgataccgcatgggtaaaccgtggttctggtaatatcaagcctcaatatttgatctctattgatcgtaacgatttcgaaggagttgaaggcgtaccttgtacggaagatgaccatcactttaccgcagaaggtaaaccgacagataaatggcattgcgttcacgcaaaaccggctgttccgggctttgaaagaggtaaatatttgatcaatttccatgatttcgctaataaatatggttggtcaacattatcaaatggggagcaagatgctgactacatgtggaagaaatatgatcgtgcaggtttcgtggaagctatccgtgtagctgatactttgtatatcttgagagatgagttcaagaacttaccgaacgagaagatcaacttcgctgatttgaacaaggctgaggaggatgcttggactgcggctaagaaggctggagtatctgaagatgaatttgtttcacacaaatatatcttatctggtgataaccataagtatgtgacttggtctatgcgtttcgtaaacaaggaagttgccgctaatgaggtagaagctgatagagcattcttgttcgagtctatgaagagtaaacatgtttctgattacaataattctgctatgggtgacatcgctcctacatatgcggcttggttgagaatgcagaatggttgtttagttctgtctgatgatcgttcttctaatttcgatgagatgaatacaggtggtgacgatgctttgatctttaatgtggagcaaggtgatgatatcgcaacagataacgaaacaatcgatgctgtagaaggtatctctgtagtagccggtaacggtaccgtaaccgttcaaggcgcagctggtaagtctgtagttatcacgaatatcttgggtaaggtaatcgctgagaccgttcttacttccgataacgctacaatctctgttcctgccggtatcgtagcagtggctgttgatggtgaggaagctgttaaggctatcgttaaataagaatttaacaaaataagataatcatacaattcccgtgcgggtatcgatccaagtaatccgtgacggatgaacaggcgggagttggattaatattaatactaaagtaataaattaagaggtccgtaagtacctccgtgaggaggaagtacggataaaggaacaagaggatgcgtcgatataatgtacgcatcctcttttgtgtttatagcgggtgttgaggataaatcctgcttctacttgcaaaagagcgagataagcaacggcacgctgatctcgaggataatcccgtgaataatagccacaggtacgatattctttccggaataccggctgataacgggaagacaaacatccatagaattgattcccgccacggataccggagcgaatttaccaaagaaagaggcatacaacggtgccccgaataaagctaacatttcccggatgatattagccaataacgcgatagccccgagttgcgaagcgatttctatccctgccgacgcctctttcagttgtacgataagcaaggaggataaggaataataagcgaatccgcttcctacagccatacaatcatatatattccacgaggtcaataacaaactcgccgccgcagagaatactaacgtgccgatgatcgtaaagaacggcagtaacaaactggaaaaccggatatcctttaccatctttcctaattcggcgtttgctcccagattcaatcctacttggataacgagggcgtatagcaagaattgcggtagtttttcgcaatacgtggagatagtcgtgttggcgaaggttccgcaaaagattcccgctgtgaaacataagataacgattaggttatttttcattgagacctcctttcttgataaataatttataagcgataaaagatgctaccagacttcccaatactccgcaaatagctagtatggcagcttgtattccaaactcaccaatattattcagcaaagattggttggctcctatggtaataccaaatatgaacaacatcgcgaaaatcgtataagagatggaatgttccaatcccttgaaagcggggacgtgtcggcataaataaccgacgcttatccccagacctaatagacctagaatgataaacataagcatattgtattttgagatgcgcaagacatcctttccccggaaacgaagcatacgaatactccctcttttccgcagaagttaaacttgagtgcaattaatacctagatgtaggtgtagaagagaactataaaaagaagtcctctcaagaagagtatgaatggatttagacaaaaccgctgaaccaatgaacatgcacgatcgtgttacccgagaaagctcgggtataccatctttttgagttgttcagaagcttcttgttcatcttatttgtatcattgtttgatttctggcgcaaaggtagtaataaattagagattctaaaactttttctaggatcggatatataagggacttgacttggattttggatctttttatgtacatttgaggtcctacccgctattgggccaactaaaaacggatagaacagatatgattaaaagataagattggttatgaggaaaagaatgattttaacagcattggcggctgtcgctatccctacgttgttgatggcggcggatgaggcgagattaatgcgctttccggctacaaatggttcagagattgtattctcgtatgctggcgatttatataaggtccaggctacaggtggtgaggcacagcgattgacatcgtatgtggggtatgagatgtttccccgtttctccccggatggtaagacgatcgcttttacgggacagtacgacggtaacacggaagtgtacacgatgccctcttctggcggtgagccattgcgtatcacttacacggctacgaatagccgtgatgatctgggcgatcgcatgggcccgaataatattgtgatgacttggacaccggacggcaatggtattgtttaccgcaaccgcatcagcgatgggttctccggtaagttatatacggtaaataaagaaggtggcctttccgaggtggttcccttgcccgagggcggcttttgtagctattcgcccgacggaaaacaattggcttacaaccgggtaatgcgtgagttccgtacatggaaatactataagggcggtatggccgatgatatctgggtttataatccggagaagaaaagtgtagagaatatcacgaacaatgaggcgcaagatatctttccgatgtggattggtgatgagatctatttcctttcagatcgggattacacgatgaacttgttcgtttacaatacgaagactaaacaaacaagtaaggtgacgaacttcactgagtacgacgtgaaattccctagtagtttcgggaatacgatcgttttcgagaatggaggctatatctataagatggatgcggcgtcgaagaaaccggagaaagtgaacgttacccttgcctccgataatgtctacgcacgtagcgagatcaaggatggttccaaatatatcacgagtgccagcctctcccccaaaggtgagcgtatggtggtgacagctcgtggcgaggtattcaatatcccggtagataaaggggttacgaaaaatatcacccgtactccgggagcgcacgaacgtgacgctcaatggtcgccggacggaaaacatatagcatatatctccgacgctaccggcgagaccgagctgtatctccaagattccgaggggggcgagcctacccagttgaccaagaataacgatacgtatattcgtactttccagtggagtccggattccaagaagattgtctatacggatcgtaaaaatcggatcaatcttttggacgtatctaacaaacagctaacaaatatctcacaaagtctgttaggtgaagcccgcaacgtaagtttctctccagataataattggttgacttattcccgtgtgtccgataataatttctcaatcgtctatgtctacgatatcgcgggtaagaaagaatatcccgtgaccgataaatggtacgagtcttattctccggtattcagtacggatggcaaatatctggtattcacttccgcccgtgatttcaatcctacgtatagccaaacggaatggaatcatgtgtataataatatgggtggcgtatatctggcgttattgtctaaggataccgcttccccgtttatggaaacggatgcggaggtagccattgaatctaccccggcgaaagcggatgcctctaaaaaggacgagacaaagaatgaggcttctactccggtcgtaaagattgatatagagtgtattacggatcgaatcgttaagctccccttgccgggatcgaattactacgatctttattccgatggaacgaacgtgtattatttcacgaaaggcggcatgaagatgtttgacttgaagaaacagaaagaggaaaccgttagcgatgccgctatgatggttgatccggctggcaagaaagctgttttctttaaggacgatcaactattcgtaaccgatataccgaagggtaaagcggatttaagtaagccggttaatctggcgaatatgaagatcacggtagactatacgaaggaatgggcgcaaatcttcgatgaggcttggcgtgctttccgggatggtttctatctggagaatatgcatggcaaggattggaaggcgatcaaggagaaatacgccgcccttcttccttacgtgaaaacacgtttggacttgaattatattattggcgagatgatcggcgagctgggagtagggcatgcttatgtgaaccccggtgaggtggaaagtcctaaacgggtatcgatgggtctgctaggtgctgaggtttctcgggataagagtggtttcttccgcttggaaaagatcctgccgggggcttcttggagtaaggaattacgttctccattgacagagccgggtgttgaggcgaaggccggagagtatatcgtcgctatagacggagtacctacgaatagcgtgaacgatatgtataagttgttgatcgggaaggcgaacgttccgaccgagttgtccttgaatagcaagcctcagttggcgggcgctcgtaagatcgtggtcagtccgttggcggaagaatattctttgtatcactataattggatccaagataatatcaagaaggtagataaggcgacgaacggtaaggtcggttatatctatatcccggatatggggccggaaggcttgaatgagttctcccgctatttctatccgcaattggataaagaaggtttgattatcgatgatcgtgcgaatggcggtggaaatgtctccccgatgattctggaacgtctgtctcgtgagccgtatcgtttgacaatgcgccggggttcttctttgatcgggaccgtaccggatgccgtacaggttggcccgaaagtttgcttgatcaataagtattccgcttccgatggcgatttattcccgtggggcttccgtgcgcttggcttaggtaaattgattggaacccgtacttggggcggtatcatcggtattagcggcccgcttccttatatggacggtacggatatccgtgtgcctttcttcacgagctatgatccgaagacgggtaactggattatcgagaaccacggtgtggatccggatatcttgatcgataacgaccccatcaaggaatggaacggtgaggatcaacaattagaccgtgctatcgaggaagtcatgaaacaattaaaagaacgcaaaccgctagcccctgtccccgcaccaagggactggagccataaataatgagaggttatttgtagagatggggcacgcctcgtctctacaaataaatagtaaacggattaaaaactagtaatctatctatggaacgattcgcagccattgactttgagaccgctaatggaaagcggagcagtatttgcagtataggtatcgccatattggaggatgactgggtagtagatagcatttataccttggtacgtcctacccctaatttctatacccgttggactacggctatacatgggttgagcgctgaggatacgaatgatgcgttatgtttcgaggaggcttgggaaagcatcgccccgaaactaaaggatctcccccttgttgcccataacagtccgtttgatgagggatgcctgaaagccgcccacgaggtatatgacttagcctatccgaaatatcccttctattgcacttgccgtctatcccggaagatgtacccatttctggtaaatcatcagttgcagactgtagccgcccactgcggttacgaccttacccaacatcataacgccatggccgacgcttacgcctgtgcccatatcgcccttacgatgatgcgggaaaaagaggtcgataccttggaggcgcttatggcttcctgctactctaggtaactatggggtgtttttcccggctattttatccaccacgacagcgatagcgccatctcccgtcacgttgcaagcggtgccaaaactatccatggcaatataaagggcgatcattaacgcttgcagtgtctcattgaatcctagcatactttgcaagatacccaaagcggccataatagcccctcccggaacccccggagccgctaccatcgtaattcccagcatcatgataaatccgctgaaattggagaaggtaaccggttctcccgccatgatcatgatagccatagcgcaagctacgattttcatggtgctacctgccagatggatcgtggcgcaaagcggaacggtaaagatcgctatattctcccgtacgccattcttgacagcctgcgccagtgtcacgggaatcgtggcggcggaggattgggtccctagagccgtagcgtaggccggtaacatattcttcaagaggcggagcggattcttcccggctatggctccggctatcgtgaattgaatcaataacaataatacatgtaaggcaaagatgactatgataaccttaaggaacatcgtgataatactcatgacttgtccactcacggtcatgttcaggaagataccgaaaatatggagcggtaataacgggatgataaccacctcgatcagcttaatgataatttccttgaaatccgtgaaagagtcacgcagggtggttcccgctatattagaaagccctaggccaatcgtaaaggatagcagcaaggctgtcatgacatccattaaaggcggcatatttaccacgaagtaaggtgtcagcatgaaatcttccggattctccatcgccgtcaattccgtgttggtcggtagtatgtgcgggaatatagccgatccgctcaggaacgtgaagaaacccgagaagactgttgaaccgtaggcgatcaaggcggttatcaataatagctttccggctcctttgcccagatctccgatagcgggagtcaccagccccaatatgattagagggatggagaacgataggaagttgccgaacaatgaattgaaggttacaaagatacgtgcgattcctcccggtaaaaactggccgaacaatacgccggcggcgatagcgataacgactttagttaacaatgatactctgatcttcttcatggtgttgctttattttgaagccaatggcggccatcgtaatactcatcaacggactgatcaggttaaagaagcaataaggaagatacgtcagggtcgctacgcctaatatcgtggcttgcgtcatgccgcaggtgttccacggtaccagcacggacgttacggttacggaatcttccgtcgtacggcttaacaggcgactctcatatccttttttcttgtagatatccttgaacatatttccggtaaggataatagatatgtattgatcggccgtaacgatattcaagaataaaccggagaatacggtagacgccaccatgccgaccctccgtttcataaagcgcaggaatacggacgtaaggctttctagcataccgctggccgtcatggaaccaccgaagcacatggcgcagatgatcagccagatcgtattcatcatacccgccataccccgggtggcgaccaagctgttcaaggcctcgttgcccgtatcgatttgggtactcccgtagaatgtcatgaataatcccttaaacagggaggaggcatccgctaccgacgctcccgctacctcttgcaataaatgaggctggaaaaagatcgcgagcacccccgccatcgctgtcgagataaacaaggtgatcaaagacggtactttcttggcgattaatatacccgttaccaccggtacgatcagtagccagagcgagatattaaaactttcgttcaacgaggcggcgaactcggctatttgcccggatgcgttcgaggtatgcgtaaaacccgctatggtaaagataatcaacgtgatcaccatagacggtattgtcgtaagcatcatataccggatatgggagaacaaaggggtatgcgttacggaagaggctaataccgtcgtgtccgaaagcggtgagatcttatccccgaaataagcgcccgagatgatcgccccggctacccaccccgtagcgaagccctgtgcctcaccgatacccatcaaggcgataccgatcgtggcgatggtagtccacgagctaccggtcataacggatacgacagcgcagatcacgcaacaagaggccagaaagaaactcggatggataatttgcatcccgtaataaatcaaggtcgggacgataccgctgatcatccagctaccggatagagcgccaatcaacaataggataattatagctgtggccactcccaatatgtttttacatatcgcctcttctatatcacgccatttgactttgcagaagatcatggccaaaagggaggcgaccgccgtggtggtaagtaatacgacttggcttccgccgctcaacgcgtcgctgccaaaagtgcgtatggttacaaacaaaagagctaccagcacgaggataggcactagtgaaagtagaggggagggcatcttcttaagatgattttccattgttcattcagtcgcttaaataatgatggtgcgaaaatactaaaaataccttgaatagcgctatgaattatagattgatttccttatttcacagtcttttggacgatcttataaccggttgccgctataagaatgctcataaacgggctgacgatattaaagatgcaataagggaaataagtccaagtagatacgccaaggattgtagattgtgtcatgccgcaagtcgtccacgggatcagcacggaggtgacggtgacggagtcttccgttgtccggctaagcaggcggctctcgaatccacgttgcttatatacttctttaaacatttcgctgttcaggatgatggcgataaactggtccgccgtgcagatgttcaaggataatccggacacgacggtagaggcgaccatgctggtacggcctcgcatgaaatgcaagaagatacgtgtgatgctttccagcatgccgctagcggacatggccccgccgaaacacatggcgcaaatgatcagccaaatcgtgttcatcatcccggccattccccgggtagagactagagagttcagggcctcgttgccggtctgtatctgcgtgctgtcatagaaagtcatcagcaggcctttgatataggcgataatcccgctatccgtgatcccggaaatctccaataaggcgtttggctggaagatcaaggcgaatattccggcgagtatggaggaggcgaaaagcaccacgatcgaaggtgtcttcttggcgatcatgattccggtaacgatcggtacgatcataagccaaggcgtgatatggaacgagcctttcaaggcttcggagaaagtggctatctgggatgcgtccgctgcctccctcgagaatccggcgatgctgaatacgatcagtgtgacgatcatagagggaacggtcgtataaagcatataccggatatgcgtgaaaaggggcgtgtccgttacggaggccgccaataccgtagtgtctgataacggcgacatcttatccccgaaataagcgcccgatataatcgctccggctacccaccccgtactgaagccttgcgcctcgccaatcccgatcaaggcgatcccgatggtggcgatggtagtccacgagctacccgtcataaccgatacgatactgcatagcaggcaacaggccacgaggaagaaatccgtttgcatgacttgcaacccataatagatcaaggacggcacgatcccgcttaccatccaactgcccgatagggttccgatcaataaaaggatgatgacagacggtgcgatcccatagatgttacgggcgatttgcccctcgatatcttcccacttgatcttgcaatgaaagacggcgatcaaagagcagatcgaggtggctatcaataagacgatttggctggctcctccaagggaatcgccccggaaaatatagatggctacggccagcatgatgactaatgtcactacgggtagtaaagagatcgcgatggagggtgtccggggcttttctgccatgggtttattcacgtcgtttgttatttatcatggataatccgaataaattctttatacggaccttccttgtgttatcaattctaattaatttcgctgcaaaaataaaaaaggatttggataggggggtaacttatggtagtaaataatcggttaggctatttatttgtctttttggggatgagtatggcgctatatgcccagcgaaagacggaagtgatccgttatggcgatctggatcagtgggtggtacgtaagatcacggaatcggctattatcgggaaggagacaaagactctttactgcgttggccctatggatacgattatcggaaataaaccttttgagccgaaagcttcgccttggggcagttctaacgtgatggcaagggtgagcgggattacgaaagctagcgtcagtgtctaccccgaaagacgggatgaggggtattgcgcacggctggagacgggtatagaatcgatctcggcgatgggtatcatgaacgtgaaggtgctggtcggtggatgcctctatctcggccgttttctggaaccggcgaagaattcttcggagacgtgggggcagatcgtttgcggtatcccgtttcaccaaaaacctacgtccttgttattcgattataaggtgaaactctccggtgatcccaatcgtattaaattgagtggttttagcaagagatcggaggtaaatggcattgatatgcctttggtgaatctctttcttcagaagcgttgggaagataaggacgggaacatatatgctaagcgtatcggtacgctggtaatccggatggatgaaaatacggattgggtaaacgatgccagttttacgatcttatacggcgatatcacgaaacgtagcgattatgaagaatatatggggtttcaactcggtgagtccgcccgttatagcttgaacagcaaaggcaagaatgtgcccatccaagaaatcggctggggaacggaggacgatgaggtaacccatatgatcttagagttctgttccagtcacggaggctcatacatagggtctccgggaaataccttttgggtagataatatccggttgggatattgatcctattatcgttgaaaccctatggtatttgtctccggtcttgatacagaagccaacaaatgaagcgtagcttgttttattctatggtttcgtgatcagaatataatagtctgatattagcctctaatattctgaatccactcccatggtcgtgcggcataccatatttggggccagatttatagctcccgattcttatatcatacattatcttcccatcggttaagagtgatataaaacgttcaaatgatggctctgtatatatatcggctttattgaagtagaagagttccttacctccttcttttttcgtttgggcagttacatataataagttctttagcttctttgttagtgctttttgaatgtcttgataggtgtaacctatgctacaatctaacagctcttttgtatttaagtcaaatactcctattaatattgtcttggcgacagggttgtttaggagtttaaaagaatatttcttcatatatgtgttatagctatttgcaaacatagacgtatgcaagctatttatagatggtgcatcttcataaggtgtgccaaatttatcttttaaataagcattcgcgcgtttgggaaatgaggggcttttagtgaatagggtaacgtaagagcatgaagcgccgcgatgagattttatttcgaatccagctaaatcgggctcgtctaaattgttctcgacaactccgatgtaatcttcaaatgtttttccaatcccagtattgttggctctattgcttggaacatattccaaggatttaacctctttgaactttgaaataataaaatccttattctccataacgtattatattaaatatgagtaagtcaataatatctctatctttggaaaaatcttcctctgatatgaatagctgttctatggtaatgttgaaatagtggcatattttatagatctgactaagggtgtacttatgtggaaatttagggctttctatactccctattaagcccggagccacttcgaggagattcgacaactctttttggctaacattgttggcctctcttagctcctttatcttaaggatgatttcaagttgatactcggtctttctaatcattattgttatttttgcccaaaaatatagttttatatatgcttatgtactcacaatatgtgagcaattgagtatatttgcactcacataatataagtaaggaaggtatgtacaaaagaacgattgataataggtggagctttaaggatgccgataccaaagaatttactcattgctatcatgcgtatcctgcgatgatgattccccaagtagcaagagctctaatagaggaatataagccagaggatggagttgagctactttttgatccatatatgggaagcggtacatcgttagttgaggcttctataaaaggtataaacgcgataggaacagaccttaatccattggctagattgatgagccatgtaaaaacaacccattatgatttatcttgtatcagagatactttttcaatgatgcaagccttgttctttgagtattctgaagataaggtcaagaataagaatttcgataatatttctaattatacttattggtattccagagatagccttttgcgcctttcttatatttatcaagtaattaatgaatgtgtggctttggatttcgctgatttctttaaagttcctctttctgagactgttagagaggtgtcgtttacgaggaatggagaatttaagcggtttaggatgaaggaagagaaaattaaagacttcaaaccggatgtctttcgattgtttgaagaaaaggttataagaaatataaatggacttgaggagtttaatagtataaaatatccatgtaatataggtatctatgactttaatagtactatagaaatcccttccgatataatacagccgaatagtgttgatatggttgtaacctctccgccttatggcgatagtagaacaaccgttgcttatggacaattttcaaggtgggcaaatgaatggttcaattttgaaaatgctaaaacactagataatctcctaatggggggacgagttcagaaagaggaactttttgagactaaaagcattaaatctgaactggacgaaataaagagcattgacccaaagagaaatttggaagtggtctcgtttcttaatgattatagctgttctataaagaatgtcgcgtctgtaataaagagtggtggagtcgtttgttatgtcgtagggaacagaacggttaagggggttcaaattccattagattactttactgctgaaatgtttgagaagaatggttttacacatatcgatactattgttagagaaatacctaacaaaaggatgccttccaaaacaagtcctactaatgtggcagggaagaaggttagtacgatgtgcaatgaatatatagtcatattggagaagaaataaggaaagaggctgttttatttgactgaattgatagccaatggctcctagtgtcgagttctttctttttgacagtttgtaatcttaacgcccgtagaatcgattattgcgggggaatgtacagtctactcttaaatttgagttaaaatatatttaatcgcttgttggatagttggatatcaaaagatgctcttttgttctagcgaaactagctcatcctaattcctattttatgggatgaaaaacctatctcaatgggttacgatagggaagtgacagggttatgatggctattcttgatagttcacgaccctattcttgactattcacgatgcccaacggcactattggcgttgccaaacacgaccgatagcgtaggcttttgtcgatactcgtgtgtaaaaagtagtactttgccgcataaaacgccgcttacaacctcctttttcccattatcttgcctcttttacgaataggctatgtcacgatatgcgctttatttcggtcaaaaggattgtatgaatgctgttttactgacagggagattcgcgggaaatagtctgtattggaagtaaaatataaatagataattgaaagtagaaatgaattgttcttttaatgtacgctcgtacattaatgtatagttaaatacgttgatatttgagaattttttatgggatagaaacgactagtttaaacgatcgattcttttagtcatttgcaaaggtacgcgtttcttcgatacttgcaacccttccgagctatttttttatcacttattctctttcttatcaataggataggttatcctctacgaaacaaccgattctttcaacaaacctcccgtttcgacactaaaaaaacgcaagatttagacgatcgtttagactagtcgttttcgagtagtggtcgatgatttaaagtgttgaacggtatttaattaacactattattaatattaaattttcgatttatgaacaaaaagtttacaacgtttctggctagtgccatgcttgcgactgcattttccgcaggtgcgcaggttgatgcgaagaaaggcgacgtaatcttgttgggaacagaaagtagtaaatacttgactgttgagacaggagaacaattcggcaaattgaacaattcggtgaatgtttcaacgaatctttcttccttgaacaaggctacttggactgtttccgctaagaaaacctctttaggcaaagacctttattcattcgtgaataaggctacaagcttgactttggctgtcgatcctgctacggcttacagcttggaggatacgaagaattcaaagaagatcgctcttacgttaggtggtggctccgctacagaatgggtgagtgaaacggtaaataatgtaaatactatcgtttcttacaacggagattatatcttggctattgctaatgatcctgcgattggttattatctggtcaaggctaagactttggataaattgggtacggtagttgcgttaaagagcgagaaacctagtgagactccaatgcctttaggtgctgatgacttgaatacattattgcaatcagtagagacggacaaacctgctgagttgttctttggattgaacatggatccggaagttacgaaagggcaaagcaatttaatgacagctacggctttgaacgctcagaatgctggtagtggttatgtttatttacaggctaaagatcaaaaatttgatgggaaagatgcttatgtagttgttgatacggcttactatggcggtacggaatccgacaagcttttgaaatatacttatgaccatatggagtatgcagataaggctaaacgtctggacggctcatacaagtttaagttttcttataatgctgcgaaggaagaattgtatgttcaagtagcggaggtagctcatgaatataagaaaggtgataagaatgacgatcaatggaaagcattcttgaaagagaacaacaactctacgtggactcagagtggtacgtcagagccactggaaatagttaaagacgagtacatctacatgtctcaattgaacggtatgaatgtattgactgtcaatgttgcgaaagatgaggacggtgttggtactcgtaagggcactgatggtagtggcaataaattatatcctgttctgggcgatcagaacgtaaaggttacgatcggaacgaagttcacaggcttgacattgacaaccattcctaatggtgtctatacgatccagtataaatctacaggtggaaaccaaccggagaaaaatggcacttacgctttggcgaacttagccggaagtttcggttggacatatcaagctaagagacaagatttcaatcatatacctgccgctcaatgggtagttgagaagaacggtacttccaatacggctacagtaaatatcacgaaccgtgagttcaatgatagattaaagactacttctcctcttcagttctttaaggtggaaggtagtgatgatgtattctgtttctacggacatggaactgataccttgtctttcaagaaagttgcggatgaattggttgccgacaagaagttaggttacaaatatgtatccgctgatgaggctaaagttcagacttatacctttaattacttgcatggtttggcattagataaatatctgtatactcctgcaggtaaggactctatcgtacgtgtagacgagaacgacggtaagtcaaacttccgtttggaattggttgtagagaatgatacgtacggtgttggtgatactttagtgagaaatgtttattatgtatataatgctgttaatggcgagaagcgttacttatcttatgacggtaccgcaaagaaatacatgatgaagaaaaatccgaccccattcttcttaaaagagaataactgcatcgatggtaagcattattatgcgttggtagaggcaagctttaagacttatacgacagatactaaactgacttcggatctgtattataaaggaggagatggctactattattctgtaaaatggaactatttatcttatgaagatgataaaggaactacatattattcatatatagtaaatgataaagatggtaatcttgttgttgcggataatagtaaggaggatgtatatctcttcactaaggaaaacggtaagtttgttctgaatgaggatcctacagcggaagattatacaaatgagtctaatggatatgctaaaattaaagtctctgttgatgataacaccttggatctaacacaaggtaatttgaatgacaagttcaatggttatcaagaaatccgtacttctgcattcgctgtagagatcgatgactctccattataccgccgttttaacaacactgtgttaggtgagaacgaaaccgctgatagcttgtactttgtagagaagactcgtggtgagtacttgatggatgaatggaacaagaacttactggataaggatgttgattacgccggtatctggaacaaggaaaaggctaatggcaaattggcattcatcatcgactctgtttgggtaaatcgtggcttgggtaacatcaaacctcaatatttggtttctgtggctcgtaacgaccaagccggtactccgggtgttccttgtacatacgaacacaatcactttgataatgcgggtcatcaagttagtgccgctgagtgttctcacgctactaaggcccatgctggtttccattatggtaagtatttggtaagctttggcgattccgctatgatcaaggatcacgaattggagactccgtatatggatattgatggcggttacactcgcgtaggtttcgtgaaggctattcacgcaggcgacagcttgtttatcttggtaaatgagttcaaggatatggatccggctaagttggacgtagctgatatcatcgatgcatacacgaaagctaagatcaacacgaagtatatcgtgaacttgcaaggtgacaaccataagaacgtaacatggtcattccgttatgtaactccgtctaatgtggctggcgtaacggctgaggaaggtgaggctaatgagttcttgttcgaatctaacatctacaatgagggtgctacttcaactcttgatgatgtgttggtagacagcaaggataagagcaagggttatatctctttgggtggtaaagctactaagggttacaatgaggctgtagccggctccatcgctccttcttacgccgcatggttgaagatgcagaatggttgcttggtattgactcgtggtgattctaagtttgatgcagctaagactggttctgacggtgccttgatcttcaacgcataccagaagactgacgctgaggatatggtaacatctatcgaaggcgctaacgctgaaggcgtatctatcgtagccggcaacggtactgtaaccgttcaaggcgcagccggtaagtctatcgttatcacgaatatcttaggtaaggttgtcgctgagactgttcttacctccgataacgctacaatcgctgtacctgccggtatcgtagcggtagctgttgacggcgaggaagctgtaaaggcaatcgtgaaataagaaataaacgaaataagataatcatacaattcccgtgcgggtatcgatccaagtaatccgtgacggatgaacaggcgggaattggattaatattaatactaaagtaataaattaaagttcatccgtaagtacttccgtgaggatggaagcggataaaaaaacaagtccttggcaatgtgttcgcatgccaaggacttcgtgtttatacttgccttcgtcagacctaatgagtgtatgaattgtttaattctgcgtaagcaacttcgtcagcctcttgaccccttccgaggctccggcctgtatatgctcgatgtcgtcgcgataagtacgtacatctttcgggtcgatcaaatagatcggctggccccgacgcacgtagttcagcaaaccggcggcgggatagacgtttaaggaggtgccgataatcacgaagatatcacaatcttccaccagcttgatggaaggctctatcatgggtaccgcctctccaaaccatacgacgaaaggacgtagctgatttccgtgagggtccttgtcacccagatgaatatccgggttctccggcgatagatcgtaggtcgtgtccagatcccttacggagcatgccttcatcaactctccatgcagatggatcacgtggctgctacccgcgcgttcatgtaagttatcgatattctgggtaatgatccgtacgtcgaaatctttctccaaggcggctagcccgaggtgaccggcgttaggtttcgtattcaataactctcttctgcgctggttgtagaagtcgagaaccaatttagggttggcggcgaagccttccggcgtggcgacatcttccacccggtatttctcccataacccgtccgagtcacggaaagtggagataccgctctctgcgctcattcccgctccggtaagtatgactaactttttcatctgttacttgtttaatgtatagatgtatatattaatagttacgaagttacgactttatttcgtaaaaagctttgaatgaaataaaaagttcttacaaaatgctgttatacgattaaaagcattacttttgtggcttataattagttgaacaagaaaaaagaatggataaagtaagttatgcgcttggcttaagtatcggaaataatttccagaactcaggcatcaaggatcttcaagtggaagattttgtacagggattgaatgacgtcttaacagaggcaaaacctgctcttagttatgatgaggcaaaacaagtgatcaatgattacttcatgaagcttcaacaagagaaactggagatcaataagaaagccggtgaggagttcctttctatcaataagcataaggctggtgtggtagagttgcctagcggtttgcaatacgaggtgctgaagaatggtacaggcgctaaacctacggcgaacgataaggtaaaatgccactatcacggtacgttaatcaacggtcaggtgtttgatagctccgtacagagaggcgagcccgccgtattcggtgtttcacaggtaatcccgggatgggtagaggctttgcagttgatgccggtcggttctaaatggagattgtttatcccgtctaaccttgcttatggcgagcgtggggcaggtgaggctatcgagccgaatagtacgttgatcttcgacgttgagttattagatatcgaaaaataatatataagagttaaagaaaaatgaaaaagttaagtgtattagtcgctacagtgattgtagcaatgggcgcatctttcacctcttgcggtgattctcacaaaagcgcgagcttgaagacttctatcgatagcgcaagctacgctattggtatcagcacaggtgccggttataaggaaaacttaaagactttgccgggtggtgaggctaacgtagatgatttgatcgctggttttatccaagctatcaaaggggattcttctgcgatgaagatgaatccgcaacaggctcaacaatatttgcagacttacttcgtagaggctcaggctcgcgaggctaagaagacaaaagaagagggcgataagttcttggcggagaataagacaaaagaaggcgttatcacgactgagagcggcttgcaatataaggtagagaaagaaggtacaggcgcgaagccgaccgctaccgataaggtaaaagttcattataccggaactctattggacggtactaagtttgatagctccgtggatcgtggcgagccggctgagttcggtgttggccaagtaatcaagggctggactgagggcttgcagatcatgccggtcggttctaaatatatcttctggatcccggctgagttggcttatggcgaacgtggcgcaggacaagatatcaaaccgaacagcgtattgaagttcgaggttgagttgcttgacatcgtaaaagaataagtagcgaagaaatagaaacggaacgtttgtaagataataggcgggcaaattatgctaaaaagcattttttgcccgcttttattatttattgattacttttttctttcagaatgatatatgattcaaatttattatatacttttgatacattaaatctgaatgcatataataaagcgaatttaaaatggagaagatagacaaactggaccggcagatattgaacattatttcaaagaatgctaggattccttttaaagatgttgccgaggagtgcggtgtatctcgtgcagctattcatcaacgggttcaacgcatgattgatatgaatgtgatcgttggctcagggtatcacatcaatcctaaaatattggggtataatacatgtacctatatcggcgtgaaattggagcgtggatctatgtacaaggatgttgtcccggaattcgagaaaatacccgaagtggtagaatgccatttcactacgggtccgtatacgatgctgatcaagctgtatgcccgtgataacgagcacttgatggagcttttgaactccaagattcaagagataccgggtgttacggctacagagaccttgatttctttacgccaaagtgttaaacgtgagatccctatctgtaatatcaatgaataagacgaagaattatacatgagcccggcctattccagtgccgggcttttttgtttattcggcggtatcatctatctttgtaattcgtaattgtgtgaggttctatgagtaaatatataggaatattcgttttcgtattcagtttgttttctttgggagtacatgcgggggaaagttttcgttttcgggtgtatttgaaagataaaggggattccggttatacgctggataacccggaggaatatctttccaaggagtctgttgagcgacggaaccggcaaggtatatcggtgtcggaatcggatttgccgatcgctcaagcttatctggataccttgtccgccaatggaggaaaaccggtgctggagagcaaatggttctctacggtcgtggtgtccagtccggatagcttggtcgctgagcgtctcttgcgcctcccgatcgtggattccgtgaaatgggtctggaaaggtgacgaggaaatcgatattcctagggaggagaatgatacgacacggtttatgccaatagataaaccggagaaatcgccttacggttatgccgaggagcagatcaagatgctgaacggtatcaaattgcatgaggcgggctttaagggtaagggtatgcgtgtggccgtggtcgatgccggtttcatgaacgtggatcggatcagcgtatttgattccttgcggttattaggaacgcataacgtggttttccccggccgaagcgttttcatcggggatgatcatgggacgaaggtcttatcttgcttggccgctgatgcgccgggcttgatggtcggtacggctccccaagccgaatattggctgataaagagcgaggatagccgttcggagtttcccatcgaggaggattattggacggcagctatggaatttgccgatagcgtgggagtggatgtggtctcttcttcgttggggtatttctcttttgatgtagaggccctgaactatcatcaagatcaattggacgggaggacttccttgatcagtcgtgccgctaagatggcttcatcaaaagggatcttgttgtttagtagcgccggcaacgaggggggcggtagctggggaaagataacctttccagcggatgccccggatatattgacagtgggcgctatcacggatcgtaagaagaaaagtaatttcagttctgttggctttacggcggattaccgggtgaagccggatgtggttgccttgggtacgggctgttgcgtgatagatcctacggggaatatccgttacgcgaacggtacctctttcgctacgccgatcttagcggggttgggtgtttgtctatggcaagcgtttcccagtctgacgaataaggatataatctctcttttgcagcgtttcggcagtaagtttgagcaaccggacgctgagttgggatatggcatcccggatgtgtacaaagcttataaacaagagcgtaaatatgcggccgaatctaaataacttatcgggtgagaaagaggctctatctttgttagagctgaatactcgtatacggggtgcgttgtcgagggctttcccggagacttgctgggtgcgtgcggagatgagcgatgtgcgggtgaatacttcttccggacattgttatctggagtttgtggagaagaatgtgcagaccgggcaattggtggccaaggtacgagggtctatctgggcgaagacgtttcgtatgttgaaaccttatttcgagatggagaccggtcagatgttcgcttccggcttgaaagtgttggtgaaggtgtctgttgagttccacgagttgtatggattgagtcttacggtgcttgatatagatccggcttatacgttaggtgatatggtgcgtaagcgtatggagattatccgccaattgcaggaggaaggggtctttacactgaataaggaattgccttttccgctacttcctaggagaatcgctatcattacttctccgacggctgccggctacgaggattttatgaatcagttgacacggaataaaggaggttatccgttctataccaaattattccccgccttgatgcagggagaacggacggaggcttctgtaatagcggctttagaccggatttatcaacatcaagatctttttgatgtggtcgtgattatccgtgggggtggggctacctcggacttgaatagcttcgattcttatctgttggcggcgaattgcgctcaattccctttaccgattatcacgggtatcgggcacgaacgggatgatacggttgtagatttggtagcgcatacccggatgaagacaccgaccgctgtcgccgagttccttatttcccgaatggatagcgttggtgaggagttggagagtttgcgtcaagacgtgagtttattggctatggatattctatcccgacagaaaaactatttacaattggtagcgacccgtttcccttctatcgtgacaagccggatcgagcggaatcgttcgggactgcaaacgatagcgagccgtttacctgcgatggtatcgggtttgttatcacgccgccagtcggtgcttgagaatacggaacttcgcttgcggaacggtattacctctaaactttccgagagtgggcgttttatccagcttacggagcagtttatcaagatggcttctcctgattatatattgaagaggggatatagcttagccttgaaagatggcaagattatcaaacatgcctctgatttgcgagccggcgaagaactgacgactcgcttcatcgatggtgaaataaaaagtattatcaaaccatagagggtggttttataaccgtccgataaatacataattaatatggcgaagaaagaagaaacatataacgaggcgatcgagaaacttcgtaagatcgtggctgagatcgagaatggagacttggatgtcgatatcctgtccgagaaggtaaaagaagctacccgtctgatcaagctctgcaaggagaagctgtataaagtggatgaggaagttaaaaaagttttggaggaattggattgatggataagtacgtcttgatcgttgccggggggaaagggcttcgtatgggtggagatctgccgaagcagtttattcctatgcgggggaaacctcttttgatgcatacgttagaggcttttcatcgttgggatgcttccgcacgtataatccttgtgcttccggaggatcatcagccgtattggaatatgctttgcaaggaaatcggctgcaaggtcccgcatgcgatcgtgaaagggggagatactcgcttcttctcggttaagaatgggttggattggcttttggcggagaggcgtcggaagggggaggaggatagcggtctgagtttggtcgctgtgcacgatggcgttcgtcctttcgtctctccggaggttgttgaggcctgctttgataaagcggctgtcacgggagccgttatcccggttgttccgatgattgattccctgcgtgagacagatgaaaaagggagccatccggtggaccgttcccgctatatggctgtacaaaccccgcaagtcttccatttggaattattgacaaaagcctatgagcaaccttattcgtctttatttacggacgacgcttccgtggtggaggcgatggggcatgcgattgatacggttcccggtgatcgtgagaatatcaagattaccacgccctttgatttgttaatagcggaagcgatgtttgcccggtaaaccctaaaaactcatagatgttatgctggaccttgataaacgatcgattacgtatttgccgggagtaggacccaagaaggcggatatcctgcaaaaggaagcggggatatcgtcgtatgaggacttgctcttttattttccttataaatatatagatcgcagccggttttataaagtagctgagatcagtgggaatatgccttatatccagttgaaaggccagattctctatttcgatacgctaggcgaggggcggagtaaacggctggtcggtaagttctcggatggtacgggcacgatcgatttggtctggttcaagggcttgaattatgtgacagataagtatcgtcccaataccgagtatatagttttcggaaagcctacggagttcgggcatacctataacataccgcatccggatatcgactcaatggagcaagctgatcaagtggcgaatggcttgactcctttctataatacctcggagaaaatgaagaaatctttcttgaattcccgggcgatccagaacctgcaatatacgttgttaagctggctgaactgggaacttccagagacgctttcccccgacgtattgaaacggatccatatgatgtctatgacagaggcaatgcggaatatccatttcccggaatctgccgctaagttgcgtgacgcccagttacgtttgaagtttgacgagcttttcttcatacaattaaatatattacgtaccgctagcgttcggaaactgaagctaaaagggatcgttttccctacggtcggccattatttcaatacgttctataaagagtatcttccttttgagttgacgaacgcccagaaacgggtagtccgtgagatccggatcgatatgggtagcgggcggcagatgaatcgcctgctgcaaggtgatgtggggagtggcaagactttggtaggcttattgtctatgctattggcgatagataatcattgccaagcttgtatgatggctcctaccgagatattggcaacccagcattatgcgacgatcatgggattcctgaaagatatggacgttaaggtcgctcttttgaccggatctaccaagaagaaagagcgggataagatattaccggctattgccagcggtgagatccagatcgtgatcgggacgcatgcgttgattgaggagacagtggttttctcttcgttgggattagcgattatcgatgagcagcaccgttttggtgtggagcaacgctcacgcctttggacgaagaatgcgatcgtgccgcatgtgttggtgatgacggctaccccgattccccgtactttggcgatgactttgtatggggatctggatgtatcggtgatcgatgagttacctccgggacgtaaaccgatacaaacgcttcatcgctatgataataaaaaggcgcaattgtatgagttccttcggaaagagatacaaaaggggcgtcaggtttatgtggtatatccgttgattgaaggaaatgagaaactggattataaagacttggaggccggttttgagacgttcaaggaggttttccctgaatataaggtatgtatggtacatggccgtatgaaagcggcggataaggataccgagatgcagaagtttatctccggcgaggcgcaaatcttgatggctactacggttatagaggttggcgtgaacgtgccgaacgcatccgtcatggtgatcgagagtgctgaacgtttcggcctctctcaacttcatcagcttcgtggccgggtaggacgtggtgctgaacaatcctattgtatcttggtctcatcctataaactaagtaatgatactcgtaagcgattggagattatggtgaacagtacgaatggctttgagatcgctgaggcggatctccgtctccggggacatggagatttggaaggtacccgacaaagtggcgaggggatagaccttaaaatagcggacttggcggccgatggacaaatacttcagtatgcgcgggatatcgctcaaggagttcttgacgaagaccccgaattattgtccgaacagcaccggatattgagcgaaaggctcaaaactctgttcacaaggaagataaattggggaatgattagctaatatgttgtgaaacatattgttctgtaagtctttgatatttagcttgtttattcgcttgttttgcttttattcaaagtcattgcagaaatttttcgttaatcaattttgtcggcttattcaaatttccgaactttgacaagttgacaatcaggcagagatgtcgggtattgccgttttatcctgaattataagaatgaaagttatcaaaaaatgagtataaggacatttctattcatttgttgtgccgctgtgatggtatcgactgctaatgcggagaacccggtgaaaccggaaactccggagactcccaatcatccaacccacaaacttatggacaagcgtgtatctgagttaatggctgaccgtgttggctttaagaaagatatggctttgaaggagcttgcggagattaatgaaaaagcggagttggaggcgagagagaacttgatgttccctgccgatgaattatatggcgaatggacaaatgaatgggtgaatcctttccggggtaaaaaggtagatatgccggattcttgcgtgattgattgttcggcgtttgttttgccgatcgatacgatgatccgggttacctctaagtatggccctcgccggcgtcggatgcataaaggggttgatttaaaggtacagatcggtgatacaatccgtgcggctttcgatggtaaggtacgtattaagaatttcgagcgcagagggtatggctattatttagtggttcgtcatccgaatggtttggagactgtatatggccatttatctaaatttttggttggtgtaaatgatatcgttcatgcgggagacccgatcgccttgggggggaatacaggacgttctaccggttctcacttgcatttcgagactcgtttcttaggtcaggctcttaatcctgccgatattattgatttcgagagttgtgcgcctcaccaagatcaatatgtatttcataatgtaaagatcaatggacgcaagagtaatatttatacatcctcaaatgagcaaatggtttatcatcgtgtaaaatccggtgacacattaggcaagatcgctcgtatgtatggtacaactgtgaatgagctttgccgcttaaatggattgaaaggtacttccatgctgcgtatcggccagtccattcgttgtagtgccggtgtggaaaccgcggctaaagcgactccaaaagctcaaactcaaaagaaatcgactgcttccgtatcttctaagaaaatcacggtacaggcaagttcttccgctaccgcttctttaggagaagacacgaatacaatgaatgatgtggaggctacttcggtttatcatcgtattaaatccggtgatacgcttggcgctatcgctaaaagatacggtacttctgttagtaaactctgcgaattgaacggtatcacaaagactaccgtgttgcgtttaggacgctcattacgctgttcataacgatatataagatgtaaggaaacgaaaaggagccgcttataaagtggctcctttttgttgtaacctcttttcatttatcttattagcttttgttgtcttgaattttcgagaacatctacgtcttttttcctatattcgcgggtataatctaggatagtatgccaaatacaaaggaacaattcgagcaagtgatctccctgtgccgggagttgttcgagaagaagttgaaagattacgggccgtcgtggaggatcatgcgcccccagtcggttaccgatcagatatttatcaaggcgaaccgtatccgtagcttggagatcaaggggacgagcatggtggacgagggaatccgtccggagtttatcgctatcgttaattatggtgtgatcggcttggtccaattggcgttgggatttgcggatacgaccgatatcacgatagagaaagccttggaattatacgataaatacattgcggagacgaaggaactgatgtacgccaagaatcatgattatgatgaggcgtggcgcagcatgcgtatcagctcgtatacggatcttattttgatgaagatttatcggactaagcaaatcgagagtcatggaggcaagacgctcgtttctgagggagtggacgccaactacatggatatgattaattatgccctcttcggtttgatcaagctggagtttggtgaggagtgagctacatggaatataaggaaaccgtaaagaaagtgatcgcagaggtctgccgcctgttactgggagtagtctttatcttctccgggacggtgaaggctgtcgatcccatgggaggagccattaagattggcgactatctgacttcctttgggctggataagctgcaaccttttacggtattgatctccttcaacttgtccgctctggaattcatgctgggtgtctgtatgctattaggggtgtaccggcggtatacgaccttcttgaccttgctgatgatgtctttcatgacgccgctgacgctgtatctggcgatcttcaatcccgtatcggattgcggttgcttcggggatgccttggtgatcagtaattggcagaccttctataagaatgtcgtacttttggccgccgctatttacgtgttcatccataatcagcggcttttacaaggctatacctaccatgtctactggttcgtggctttgtggtcatatgtcttcgctatcggtttcgcttaccggaattataatcatttgccgatcttggatttccgtccctataagttgggtgcgaatatccctgccttgatgtcgataccggaaggtgcgcccgaggatgaatatgcgtattcttttatttacgagagggatggcgtacagaaagaattttctttggagaacgctccggccgatgatagcacgtggactttcgtggattcaaagaccaagctgatcaaacaaggatacgttccccccgttaccacatttcatatttataatgagaatgacgcagacgtgactgatgagttgctgaacgacccgaaaggtctctttcttttgatcgccccccgtctggagaatgcggatgatgagcgtattgacgagatcaacaatgtatacgattacgccttggagaacggtttgggcttttattgcgtgacgggttcttccgccgaggctatcgctacatggagtgataataccggtgccgagtatccgtttcttatggccgatgatgtccttttgaaaacgatcatccgctccaacccgggattggtcttgctgaagaaaggtacgatcttgatgaagtggcattacaacgatattccacaggaagaagacctgaaaacgatcgtaaacggctatctggaaggaaataccgactggaaagcgaaagaagatgcccggctaataaccaacctattaagttttaccgtacctttgttgctggtttggggatacgatgccttgcgcaatcgccgtcgccggaaaggaaaagaatctgaatagagatttatttgtattacatatttaaattattaagttatgagaaagaatattgttgcaggaaactggaaaatgaacactactcttgctgaaggtcttgctttggctaaaggtttggacgaggctttgaagggtaagactccgaattgcgatgtgatcatcggtactccgttcactcacttggcaagcgttgctgccgctatcgatacaaacaagatcggtgttgccgctgagaactgcgctgacaaggaaaaaggtgcttatacaggtgaggtttctgccgctatggtagcttctactggtgcgaaatatgtgatcttaggccactctgagagacgtgcttattatcatgagactccggaaatcttgaagacgaaggttgagttggctttggctaacggtttgactccgatcttctgcatcggtgaggttttggaagagagagaagccggtaagcacttcgaggtagtagacgctcagatcgctggttctttgttcgacctttccgctgaggatttcggtaagatcatcttggcttacgagccggtatgggctatcggcacgggtaagactgcttccgctgagcaagctgaggagatccacgctcacatccgcgctactttggccgctaaatatggcaatgaggtagctgataactgcacgatcctttacggtggtagctgtaacgccggtaacgctaaggaattgttcgctaaaccgaacgtagacggtggtttgatcggtggcgcttctttggccgttgacaaattcatgccgattatcgaggctttttaattaattcataataagaaggtatctttcccctcaatgaatggggaaagatactctttttaatattctatctatgaaaagaattccttgtatcttattgctatttgcctttttgatggccggtacttcatctttattcgctcagacggcgttggaaggtgagcgttcgaccatattcgatgcgttgcagagatccggtttgggaaaaggcgaggtcgttatcaatcaatccgccgctatctgcgagatggtgggtgagcgtatgcgtggagcgaacgtggagacgacagatagccttaccttcttgaaggtacaagggtatcgtacgcaggtattttccggtaacaaccaacgggtctcgaaagacgaggcttttcgtaaggagaaggagatcaaggagctttttcccgaggtcccgacctatgtcacttacaacgccccgttctggaaattgcgtgtaggggatttccgctcacatgaggaggcttatcatatgatgcgcctgttgatgggcgctttcccgaaatacggaaaggaaatgtatatcgtacgagaagagataaaaattcccctaaattaaagatgatgtcagaagtaaacgaagagacgctatgtgcccgggaagctttggccggccattataaggaagtattgggtttgctgggtgaggacgtggagcgtgagggtctgcttaaaacgccggaacgtgtagcgaaagcgatgcagtttttaaccaagggataccatgaggatccggaggcggtactccgttccgccatgtttcaggaagaggattacaaacagatggttatcgtgaaagatatcgatttcttctccctttgtgagcatcatatgttgcctttctttggcaaggcccacgtggcttatatccccaagaaatatattacgggcttaagcaagatccctagggtagtggatatcttcgcccgccgcctccagatacaggagcgtatgacgatgcagatcaaggattgcatccagaggaccttggacccgttgggcgtgatggtcgtgatcgaggcgcagcatatgtgtatgcagatgcgtggcgtggagaaacaaaattccttgacgactacctctgatttcacaggctttttccaacaagctaagacgcgcgaggagtttatgaatctgatcaagcataaccgctgatgacttaatacaagtcggcatgcgtaccagtatcggtcatgatcaagaccagttcggtatcgttttgttgccatattaagagccagtcgcttttaatatggcattcccataggccctcaaatttaccgcttagtttatgggggcgatattggttggggagcgtaccggtttcttgaagaatatcgataaccctttgaagtagatgaagttctaatccccttttcttacacgttttaagatctttcttaaaattcgtggtgtattccaatcggtacatgggtcaaccaaggatttgttgaaacatatcttctgcgtttttcgctttgtgtgttcttccggccttgatatcctccagtcccttctctataccggacttcttcctgccgatattccaaccgaatttcttggccagttctttgagcaaggccatgtctacctccggtaaggtaatttctactttcttgactgtcacttccatatcttgggttgtttatagattgtatgtgacaaaaatacgtttttttattgaattgataatcatctttgagagatttcgagaaagacgatcgaaggatatgacaatctgttaggattgacaatttgtaatcggaagtctcggagaatcggtttttccgggctaaggtacgtcttgtgcttgaatttgaaaaaataaatcagcaatcggttcattgatagagcaatgccgaaaaatagccttttgttctagcgaaaataattcatcgtaattcatatccgatggagcaaaaggagggaaaaacggtgttacgatagggctataaggaggtaagaatgctcattcacgactacttacaatcctatttgcgactgcttataatgcccaatggcactactggcgttgcttaatgcgaccgtatgtgtaggcttttgtcgcctaatgtgtatcgaaaacggtctttttcattggaaaagcactgtttattgttatctcccttcctttatcttgtgattcctgtgaaaatgagaggtcatggaaaagctctaatactactcaaaaagacagaaaagtctcttcgtggatgaccttatggaaatgagaattttgcttgatcaacagctagaaaaagcctttagaagtgaataactaatcacttccaaagccgttagttattcactgggtatactcgttagttattcactcgacaagccgcaagttattcacttcagaaggcaaaagtaggagattttacctttcatcccccggatacttccgttggtcacaataatttgattggatattcctgctgatgtaattttgatataaaaacgacatgagcaggaatctttttataatagttctattgataattacccctttttgtggttggggacaggtcgatacgatagcggaccagaagttacaggaggtggtgataatggctaagctccctacggtagagatgaaatcggggaagatgacttataggctggatgcctctatcacccaaagccaagggaatgtctacgacgtgttgaccagtttgccgggagtcgtgatacaaaatgatggcactattttcttgaatggtcaaaacggagcgaatatcttgatggatggtaagccgacctatttatcggggcaagatcttgtcaacctcttaaaatcgactcctgcctccattacggataagattgatttgattacgcatccctcggcacgttacgacgctagtggaaactccggtattatcgatatacgtacgaagaagatattgcgaaggggaatgaacctttcggtaaacggtagttatgaccaaggtaaatatggagagggtttcgcttctactaccctgaatctgcgaacgaataagctcaacttctatctctcttattcctattcccggaagaatgattacgatgatctgtatgtggagagaaactatctggaaggttggcggccggaaggggagaccgggcagatgacgcaatcttcctatcgaacttggaagaatacatcaaactattatcgtttcgggatcgattatcaaatgtcggataagactacgatcgggttttcgacggatggtaatctggcgggtaacaaggttgagggagatatgaactcatccattcctaagcgatctccgcaaaccggaggttcgcttcgcaccttgaacgatcagaatcgttcacaggataattttacggctgttttaagtttaacacatacctttaactctgatggtggggtcttggatgcctctatggattacttgcgttatcgatacgaggaagaccaatatttgaatagccaagataccttgtttggggatatggatggaggaatccatttatactccggacaagcgaatctggtgtggcctttctcgaaatccttcacgttccatgcgggcgccaagacctctttcgtctctatcaataataacgctgattataatcggctacaaggcgactcttggcagtcggaccatgacttgagttgtgattttcagtatgacgagaatataaacgcaggctatatacagcttgacgccaaattctcttcggtaagtctggaggcaggtcttcgtctggagaatacccgtatagagggcgaacagtcgggtaacgcttatcaaagagactcctcctttaccaatcattatacacatttattcccaacgctttctgttcagtatgccttgaggaatgggaatagtctgtcgcttacttatggcaaacggattgtccgtccgaattaccgggacctgaatccgtttgtatatatccacgatgagtatacgtatgataaaggtaacaccttattacgcccggaattatccgataatctggaactggcctatatacatggcgatttattccgggtggggcttgctttcaattatacgaaggatgtaattatcaagagctatttggatcaagggaactatgtcgtttatgtctcaccggaaaatctctcttcccgcgtcagcgtaggtccccggctcagtacctcccaattaccgctaacctcattttggaacgtgaacgtcagcgcatccttgatctataaccggtatcgtttaccggagaattatcaagtaaaggtgaataagagatggacaccgaatatcgggatctcgaatcagtttaactttgcccggacttggagcgctgaacttatcggtttctataatgggaaaatggcggcgggacaagctacgatctatccgttatggcaaataaatgccggtatccagaagaagatatggaaaggtcggggaacgatccagttattcgcacgggatattttccattcgaatgtatcgagaatgagcgtgatgactcccacccagcacgcttttataaaagagcggatgaaccggacggtagtcggtatttcattgacctatcgtataaatcgtggtttggaggtgaaagaatctcgccggaagcatagtgtagatgaaagtaaaagaataaatttgtgaaacctctagacaaatggtttatgaaaaagatatataagtgggtatatgccatgatttttgcggtctctttgtattcttgtatccgctgggtaacggattatacgaaagaaggacactattggacacagtccttggggaatagtatcttagaaatcgtgatccttgcttttgtctcttatttgttttttatttatttcagatggcagatcgagaagagccgaagagcgaaagaaccgaatagatggaaatttgtttggagatcgtatggaatgcctttcttattgattatattgggtgtgaatgctacgttggcaataacccgtatatttaccggtgatgctttccatatggacgatataataatcgcgaacgtgatagggtgtttgtttgcgtttatggtctataatgttcagcgagctcaagtattggataaagattacgccgagcagcgtatccaactggaaaagatcaagaatgatcaattacagacggaattgaagttcttgaaatcccaatatcatcctcacttcttgtttaatgcgctcaataccgtttatttccagattgatgaaagtaacaaggcgcctcgtcgcacgttagagatgatatccgaactcttgcgttaccaactgtatggcggtaatcagaaggtcagtatcctacaagaaattgattatttgaaaacttatatagctttgcgtaagcttcgtatgagtgaacgcctgcggttgcgtgtagagtttccgcccgaattgaatgaactgaatatttatccgttactcttcctcccgttggtagagaacgcttttaaatacgtaggtggcgattatcaattggatattatcatgaaatgggaaaataaccggatcagtttgtttatacgaaactccatccccgagctttcagcggaggacgaagcgttgcgtaaatcggtggataaacggcaacgtaaaggcatcggtctggtaaatttacgccgccgattatctttgttgtatcccaataagcaccgtttggaaacccggaaagaagagactgagttcgtagcggaattaatgattgaaatagaagatatatgacaataacctgcgtgataacagatgatgagccgatggcccgtaaaggattgcaatcgtatgtggagcgagtggattttctctccttgaccggtgtatgtgaggacgctatccaattaaataccctgttgaaaactcagcagccggatttacttttgttagatatcgagatgccttatctttccggtttggatttattggcgaccttaaaccagcctcccaaagtgatcgttacttccgcttatgagcaatatgccttgaaagggtatgagctggatgtcgtggattatttgctgaagcctatttcctttgagcgtttcttaaaaggcgtgaataaggtgcacgacctgttggctcgggagaatacgccggatgcggatgcctcgttcttcgtgaaaagcgagaagcaaatgcgtaagatctacctaagagatatcttatttgtagaggcgttggaaaattatgttagtatctatactacttccggtagagtattgacccattcaaccttgaagcggatcggggaatccctacccgatgatcaatttctccaaacgcataaatcgtatataattaatgcggatcgtgtcgatttggtagaagggaatagattacgtatcgaatcctatcaaatcccgatcgcccgtaatctcagagatgttgtatttaagcgtatccttaagaatacgttgtaattaccaatttattgtatttatacgaatttcgttcttcaggcgtttttgtagtaaactaaatacggtaagttatgaagatcaaaagttgtgcatggttggtttgtcttattttgtgtttgcctataatgatgaaggcgcaggttctgaaaatagagaatggtatggctttctcttctttggtgaatgaaggtgaggacctttttgataagtctttgtcatcgtatcaaatgtctataggattggattgtttggatcagggttggtatgcattgtcaagtaatgtgggttacttacgtaaaggtggaagttttgatttctatgaggctacagatccgggactcaatatgctgaagaggaatatgaaatacatgtttgattatatcaccttgaatactacttttcgagtaaagactctttcggatagtggttggaatttctacgcaggcgtcggacctcgtgttgatgtaaatgtgaagcgtcatatttctttaggcgatatggattctttgtttcccgagcagacagctcctgccgtgaaccggattattgtcggattaaaatgtgagaccggcgttaattataatttcgatcgttatttgttgggactaaacgtcagttatcttccgagttttataaagcctaataaagacttcattgcccatgatcgaaccttcacggttgggattttactcggatataggttataaagcgatagagacgcggcatatgccgcgtctctacaactggggtattttgttatttgaataacattggggcgaattttgtgaggtagatgcgccagtttttccagatatggccgccgtcgctctcgtagtattcgtatttgtagccgttatcgtctagtttcttgcgatagtctacgttgtttttgtataagaagtcggtcttgccgatagcgatccagtataatttcggatgcttgccgaattgtactttcagcttctcatccatattctggtagatgggagattcggagccttcacgggggaggatagcggcagagaataatcccacgtaatcgaacatatcaggatattgcttagatatatgcaaagaatggaaaccgcccatggaaagtccggctatcgcacggctggatttctttttttccacacggtaattgctctcgataaacttaatgacatccgggaagctgctttccatgctaccctccatggttttaggtagttgcatattcggcttaactaaacctaggctggattctcccggagcggcctcttgatccgcgtttccgtttgtcataaccacgatcatcggtttagccttgccttgggcgattaggttatccatgatctgggccgtacgtcctaaggcgatccaagcttcctcgtcgccacccatgccatgtaagaggtagaataccggatattttttgccacttgtctcatagccagccggcgtataaacggtaatacggcgagtctttcccaatgtcgggctctcataccaacggcgggcgaccgttccgtgaggaacatcattaacgctgtataaatcaccctgtccacccttaatgataaagatattcgtaacggatgccacgtcacggttcagatagacattgttcggatctgtagtctttaatccgtcgacaataaaggagtagctatataattcggagggaagaggttccggtgtggtatattcccaaacgccttctttaccttcctttaaatcaacggtaccgggtacatccactaaaccgaactgagtctccatcttctgtgtgggaaggaaatctcctgttacctgcaccttgatcgctttgggtgccatgaaccggaaggttacggtgttatccggatgaatctccggagagatgatgttctgactaccccaaagggcttgttgggcgaacgtgatcacgctgatcagcatgaatacggccaagattgataatcttttcataatgataaatttattaatggtattactgaggtctaaagatttttacaaatgtaatgaataatctgttacatgagcaataaataggctcgataatgtgtgtctttcgtgacggggcataatgagaggtagccttcttgaatccttccattcgcaaagcgaagtggataagtctcagacatgaggcggtgtttctcgagagcttctccggcttccttctcgtaagaaacccggtaatcgccaacagccctaggcgctacataatgctggaatagacgtaaagcgaccattcccatcgtgtaccgcatattgatctcaatgcagggatgaatagcgaaagatccatccttttgtctataggccagcatatccacacctatacagcccgcgtaagtagatccgtacacttcttgtaatacagagcgtaccgcctcttggatgcgggaataggtttcttcgcccgtgaatcgggtgatgcgagagagcatggtggattgttcctctaggatgttgcctgtataggagcctcgctcctcggtattgaaaacggataatccctcgtaacggacagtaccttgcccgtcggaataaaattccatggcgaaatcctgtactttgtctaatccgctttcgatactgatcattccttgtttgttgaatgcgccctctatccagtttttcgtttttgtatccggttttcgtttctctacccatagcaatccccgtccggaagaggaatagggtgtttttaatacgaagggagcgttgcataagatcatgtatctctccacctcccggattttcgtgcagaaacgaggcgctaccggaatagggagatcgggtaggagggcctgtatcttttccagacattccgccgccgtttgcctaccggtaaggcgaaaataatcctctttccaagtcgggacggatagccggacttttgccttgtccctcaactgctcgaataaatgaagactatgcggggaaagtccccacggggccgcgtccataggagagaggtagggagcgtttttcgccagcatcgcttttgttacaggtataggagccgggtgtaggtctttgggcaaatgggcgaaaaacggaggggttgccttactatcttccagatagacaaaatcatcctcttccgcataccaaaccggcagcagtgccaagtctttttgcattttacggacatttgtcggtgccgtgtagttctgtgtccctaaaagtacggccgtctcgtggccgggattgaaataatgtatccgtgacataaaagcgtaaaaacaacaaagccgtctttttaaaggacggctttgctcgggtttatgagattgttattccagattctcgtcgatggcatcgatcttcttgaccgttaaagccatatcctctttcagcttttcgatcttgcgttccatttctttcagtaaaccgccgccgcccttggaggaaatgcttaggaagccgatgttgttttcgtaagtctgaagctcgttcttcatgcgctcgtacatacgcatcaacttatcacgttcgctgaacaaacggcctttacctctttcgccgctggtcatctcgtttaggttgttgcggaacgactgcatcttgcgatcgttctggtctaccttcaagcgatcgaattgttggtcaaccgcctcgtgatattccttgtagatcttatctttctccttgaacggtacgaaaccgatcgtgttccattccgccatataagacttcaaggttgcgatagcctcatcatgtccaaggctctcgtccatgcccttgatcttagcgatcagctctttcttagcggccaagttggtctgctctatgctcttttgggaaacaacgttcttattcttttgctcgaagaaataatcacaagccgagataaaacgtttccagacagcgtcggaatgcttacgggctaccggtccgatcgtcttccattctttctgcaaagcgatcattttatccgtcgtatccttccagtcagtactatccttcaaagcctcggctttctcacataacgcacgtttagcgtcgaggtttttctccatatcgctcttgatcgccttgtagaactcgcttttcttctcgaagtagacatcgcaagcggcacggaaacgttcgaatatctttacattatattttttcggagcgaaaccaatcgtcttccatttctcttgcaagccgattacctccttattcttttcttcccaatccttaaacgatttcaacgcactgaaatcaatcgcctcgatttgttcgcaaatcacggtcttcgcatccagattctcctgctctttcgctttcagtttctcgaagtgctcttggtgacgcttattgatcacggttgaggcagctttgaagcgagcccataaatcctcacgcaactctttcgccaccggcccgatctcacgccattgctggtgcagcttctgaagctggtggaaagcggagataacatccgactcattacctagtttctctacggtttcgcacaaggcggtcttcaattccagattcttcttgaagtcgtaatcacggaactgattgtttatcttgataatatcatagaatttctcggtgtagatctgatagttcttccaaagctcgttcacgtgctcttggggaacggccttcacctctttccatctttgttggatgtccttgaaagagttgtataatttattgaaatcatcttggctttcacaaagctctttcaactggtcgattaactgcaatttcaaagcgtagttagcggcctttacacgctcttcctcggcgaggatagcggctcttttctctttataagaagtgagcaaatccttgatcttgttctcggtttcgtcagcgggagctgtaaaatccttttcttcgccaccatcagcgatgaattccttcttgagctcttccacctcgttacgacggatcttgtagtaagcctgtttcaaagcctctacttctccacgggaagtctctacggaagtctcaacaagttcggttaacttagcgagaatttcttctttggttaatttacctgcggcaatagcagcgtctgcctccgctgtatcgttggcttcaacgtctgcggtagcatcgatttccggcgtctcaaccggttttttagtttcttccaatttcccggcttcttccggcaaattagtctcaagagtgtccttcatatacaatcgcttttaagaaaaggataaatacattcctatatcaagtcacaaattaaactaaatatttttggattacagcatttcggggaaattatttatctaaaaagtcattttggatactaatagatgttaaggttggcctatttctcttgattccggttgtagagacggggcatgccccgtctcccaccgtctacttatactatttaatcttatttatcccaagaaggaaatcaatacgccggcagctaccgccgagccgatcactcccgagatattactagccatgcaatattgcaagacatggttcttcggatcatattgcaacgcgatctcattcgccacacgagaggccattggcacggcgcttaaacccgtggctccgataagcggattgattttcttcttagtgaacaaattgaaaatcttaacgaagaagatacctccggcgatagacaaggcgaatgccaagaaaccgccgattacgataccgattgttgttaggttcaagaacgcttccgtggtcatggttgccccgacggataatccgaggaagatcgtggctgcgttcatgatactgttggaagcggcatcgaacagacggaacgtattggttccgatctcttttacaagattaccgaacatcaacataccgatcaaaggaacggagctgggaacaaacagggcgactacggtagttaccacgatcgggaagataatcttcaatacacgcaaattcttgatctccatgttagaagggtatttcttctcttgttccttcatgttgatctgtaattctttcttagaacacagtagcttaacgaccaacgggatgataaccggtaccaaagccatgtaagaataagcggcgatagcgatcgggcctagcaaatgcggagccaatttaatggtagtgaagatagccgtcgggccatcggcgccaccgataatacctaaagacgctgcctcttttggtgtgaatcccatcaagatcgctaccaaaagcaccgtgaagattcccaattgagccgcggcgccgaaaatggataggcgaaggttacggagcatcggaccgaagtcggtcaacgcaccgacacccatgaagataatcggcggcaagaagcccgtcttgatcaacatataatagatgaagttcatcaagccaagctcgtgtgcgatatcatgcagcggcatttcccagatgtttctcatcacgccgtgtacattaaccaacccattctcatccgcttgaatcactcccatatcgcctccggggaaattggcgagcaatacgccgaatgcgataggcacgagcaatagcggctcgtattgtttcttgataccgaggtagagcaatacgaacgctatggcatacatgatcaagaactgcggttcagcaatgatattgctgaacgcagtcatctcatataagttttgaaatatctcgttcattattgaatcgtcattaatacatcatcctcagatacggcatcaccggaagacaggcagatcgccgtgatcgttcccccgaactcggcacgtacggcattgtatgttttcatggcttccacgtagcaaaggacatccccttctttcactacgtcgcccaccttcaccggggtatcggaagcgttctttactaggaagaatttaccttccagcggagaaagcacctctttcccagcgcctgcgggaacgtttgttacctctggggctgtcggggcgggagccactgtcggtttaacttccggagttgagctgttggtatcaccaaaagcgacggtcacatggtaagcctgtccgtttacatctacggtcatgacttgcggagtcgtcggcatcgttaatgcagcggcaggtgccggagccggtgcagcaggagtggcgggtaccgtcggtttaccggcgttcgctttctctgccttacgttttgccacgtctgccttaaactcgaccttggcctttccagagcgatatgcctcgtattgagcggggtgcatggcgtattcgaagagttcttcctcgtcctcgccaacttcccattgtttctcgttcatcaacttgcggtacttatccaacgcgtccgggtaattgtcttgaggattaccttcgaagaacttacgtccctcggcttgcgccttctcgataatctcgggagccaacggacctgggagtcgtccggcttttccaaggatcatatcccagatatcatcggcgatcatgctccagcgggctttccccttctccatctgcatgacgttcatcaaggctaggttcttcacgtattggctgaatggagttaccaatggaggataaccgacacgcggccatacgtaagctacctcgtcgaacaacttgatcaataactggtcttgagacatcaggggtttgttgttctttatattgctcttgttgatcgtctctaggttcttctcaaggtctgccatcaagctacccatcataccgcccggaagtcccggtccgatcagcaaggaattcatcaaccggttcttcgggctgatatacaatcccaagaaatcatccatgaattcttgaaccaaggcacgaaccttcatataagcctccatattgatctcgggcaccttataaccggcatccttcaacatagcctgtacggtcagcaagtccgcgtgccctgtaccccaagaaagcggctccatacctacgtcgatatagtcgcaacccgcgttacaaacctccatgatggaagctacgttaaagccgggaccggcatggctatgatattggatagggatctctggatatttttccttgatattggctacgatacggcctaatgtgtacggacgtccgataccggccatatccttgatacaaatctcatccgctccgagttcgatcaactcgaatgccatcttggtataatactcaaccgtatgtaccggagaatgcgtgatacacaaggagcattgtgagatcataccggcctcttttgcgtatttaatagatggggcgatattccgtacgtcgttcaggccgcagaacgtgcgggcgatatccgttccttgcgctttctttaccttataaaatagctgacgtacatcgtcgggtaccgggctcatgcgaaggccgtttaacgcacggtccaacatatgcgtctgaatgcctgccgcatggaaaggttttgtccattcacggaccgctttattaggattctcgccgaataataagttgacttgttcaaatcctccgccattcgtttccacccgggcgaaacagcccatctcgataattgccggagcgactctggttagttggtctacggtcgggacatactttccggcggattgccacatgtctctgaagaccaaactgaatttgatttctcttttcatgatattaatatgtattatttatactttctcaattttgataactttcccctgtccacgggtcacggcactgattgccgatacgatggcggctgtctcctgtccggaaaggctaccgatcgcggtggtttgcgttggagtggccgtttgtacccgaacggctgccgctactggtttcttcgctatgatctcttccggcgcgtatttattcaccaagacgataagtcctttccccagatagataacgatcaaaaggatagcaaatacggtggtcattccaactaccattaacaaaagtcctgtctctatattctccatattctatatttgtggctagcttaaaaggtttctacaaaggattgagcaactttcagccaaattaaaaacaatcgcaaaattataaaatactggaaaacgatctgttacattttaattaaaaaaatgaaaataaataagcgaaacggccttttcggtgaatgattgtcagcttgaaaaaacacgtacgtgttttttccgatgcttgtacggctgaaaattcaaatatattaccgtaactttgcggtggaactctaataatgtagaactataataattaaggaataagaccatgggaaatttctttacatctttattctcttcttccaaaccggccgaagcgacggaggataaggcgaagaacgagcagaagaactttgatatcttgaaatacgacggcgtacgtgcccagaagatgggaaaacttgcttatgcgatcaaatgctttacggaggcactgaatatacaggaggattttgagacgatgagctatctcgtttccgcttatacgatggcgaacgatctagggaaagccgaggacgtgttgaaccggatggttgagatggagccggatcatatcgctacccgcttgactcgcgttaacttgttgtttatgttggataaggatgcggaggtcataaccgattgtttgcacgtgatcgagctagagccttctaatcatgtcgcttatttcatgatggcaaaagcgaagaaagcgacgaatgacgtatttggcgctatcgccgacctgacgaggtcgatcgccttgaaggaggatttcgccgatgcttatttatcgcgtgcggagattcttttaggactgggacaagctaaagaggcgctgcccgatgtggagaaagcgatcgggatcgtgccggaggaggaaagttcttatttattgagaggacgtattcatatggctttaggggatatcgaggctgcgaattctgatttccagcaggccctagatctaaatccgtttaatgaggacgcttgtatcttatctggtcagttactgatcgagcaaaagaaatatgacgaggcgatcgctttttttgacgaggcgatcgagacgaatccgtcttttgccaaggcttatagtgagcgtgggcgagccaagaatctgaaaggtgataagaccggtgcgttcgaggacttgaagaaatctttggaactgaatccagaaggcgaagaggcccagaagatgaacggacagcattcgaatttcgataatatgtataaagggggaatcttttgatcaaggtaaccactttttcaatcccattggatacctctagttgtagagacgtagcgtactacgtctcatcccttcaaaatggtaacttaaagtaaggacatactacattccaagacaaattccatacaataagtatatgaatgatatggttctgtaagttattggacattagtgtcttaaaaatacgattgtgtttttcgcaaaagacgtacgtgtttttttgaaaagtcgtaaatgtttttcgagaaacacgtacgactttttaccgaatcattcgatagagaacaagagcatacatagaaatatacgataagcctcccttatcactggatcttctcgtatgaaacagtacatcaaaaaatctctggaaacaagtttatattttttctcagcgtaggtatctctatcgaaatgataggattctctatcgtttatttcagtaagcctcaaattgctagttttaccccttaaagttgaaagttccgcctattccctacattaatgtatccatctaattttgtccgtgtaaaaagttcacaagcttgattttggaaacttagtcccgataggactatttaatctagccctattattaaatccttatattataatctcttatataaatccatcccctttagagaagaacttatgaaaatcatccttacctgttttcttgtagggtaaagagttgatactttcttgtatatcctctttacttaagcctgtttaaagtatttagtcctatcggaactaaaacgatccttatattctaaacaacgaggaataagttaaacgaataaaatatagggacatgaaaataaagacaataatctcaagtatttgcttgatgctattagcagtcgcttgctcgatggaggatgacgtgctgagggacatggagataggagattcgggaaatgttgagatagagatgggggaggccgcttttgttcttaagacttctctttcttctttggagacaaaatccttatctgatgctggaacattacctgcttctatggatgaggcagagattaataattgtacgttgatattttttgagggcacacaagtcagttccataatggaagggttgtttgtgaataaggagaattatatcgttaaaacgaaagacggaacgaaagatgattgggctaaagtgattttaaaagtgaaaaagcctagtccttattccgtgatggtaatcgctaatagctcgaagtcgtttgcgggttgccaatcggaaaataatataaaggatataatacaggatgataaggatgctttggtaaaagttgggaaaatggatatcagttttgatactgactttgctggctatccaacaattgcggaggcattgggaaagcctttagaaataggcacaatacctctttctcaactaacagctcgaatagaacttgcggaatttaatgtttcaggttttcaaggagcatctgttaaagagaaggttactgttacaggagtggatctgttaaatttgaatcctgagagttatacgataaatgagcaaactcataaaaatgcgacttatttgtctgagagtaaaacgtgtaatgtggaggtctataatggggtatcggatcttccgtcaacttattcttttgtagataataagaatctattgtctttttattctttccggaatctggcgaaggcagagagtgatcaagtaaaaatgcaggttcggttcaaaataggaaatagcaatgaggaaagaactacgaggccgtttgtgatcaataaggaaggaaatatcttacatggcgttaaatccggatatgtttatcgcttggttgtcaatatgactattattggagataaggtcgagacagaactgctttgctatacaagagattggttgaataataccatatccattcctatggaagataattgtaaacgggtaaaataaaaatacaagattatgaaaataaggaatatattatcagtgctgtttgttggactgcttttcacgagctgtaactcggaagaagaagttcagcgaggaaatgaggacgggcgggatatctcattctctatgactcttactttgggagaagtgacagcgatgacgaaagctggaggggatatcgctgaagggtatacatattcgacagaggatgaggtaaaagtgaataatgttgtggtcgctatatttaatgaggcgaatggaactgtgggtgagtgcttggagtacaagtctgtagcgtttgacgggggaattcccaattctaccgtaacgattgatggaaaaacattgattgcttataaaattgataatatacaagcaaagacaggtaaggttcgtatcgtagcgattgcgaattcaacgcattatgaggacttggctagattgggaacgactacttatgagaacctgaaaggtttgtcggaaaccgtttcaggtggaacttttgatgcttcaaatttggtaaaggtcggggagttggctgcgtatgacctaaatacggctgtgacaagtatacctgttccgatgacacaattagcggcacgcatcgatatgaagtttacggtagatgaagagccggagactgtgtctacaacagatgatacaaaagtaaccaaccagtggttctatactgtaactaaacttacggtcaagaatatcaatcagaaatcagatttaatattgcttggtcgagataatcaatatgatgatacttactctacggcaaaggatattacattgcaaaatggcgttgcgttacctttttatacctatgagaagttgaacacgacgttaaccccattgtctatatatgtaacgggtgatttacaaaagatacaggtcacgactacctttaatgaggatatgactattcaaaatgtaacgaagggaagtattatagaggaagagaaagatcattcttataaatatgaggattttaatcctacgacagcgcttgaaggatgtacgacaaatggtatcatacatggtaatagatatgagcttacaggtaaaatatccatgaagacacaacgaatcaactttacggtatctacaactccgtgggaaggtgtggaaaagtttgtcgtggatgtggttattgcggatttgaagtatttgttcgtgagggagactaaggtggtgatggcgaatatcactgagtataagatagagtttgcttctagctcgaatattacgattgatcaaccatcttatgcgacttatgaggagtattatttggtaaatggaaaaataacaaagagagatggtacgtattaccctaatagttattattacagttggactaatgataataagcacaaacaagatcaatatcctaagataagcgcagaagcaggaaaacaaggctccattattattacgagtaaattacctgtaaattattttccaaagcaatttgtttttggtgttcataatgcagaggacttgaaagtatcaggaattatcgtagatcaatatccacctcaatatctggaaggaaaagtttcgaaagatgctggtccagcagattctcctgatggggatacaaaccctaatatctttacgataacagtcaaagctgcagggaatctgataattggagatcctagtactataaaaaatggagtccgggtgactaaagacgacgctttctctgcggaattagtatctccaaaatttgtagtagcctcaagatttggtgctgtaagtacaggtacttatacatattccaaagcggtagaacgttgtaaaaaatattgggagaggttagaggatggtacctattatgaggctggcacatggagggttcctactttagctgagttagagtttatgaatacagtacaagacgcttctcctgcggtaaactatttgtttaatacaaacggtacttattggtgtgcaatgccgtattggtattatgactttggggcaaataaacgtaatcagtttactaataatgcctctagtcaaaaagctgacggtattcgttgtgtaagagatttatattaaagatgtttattaatgatttaaatagagatttttatgataaagaaattatatagcctattttccatattactgttgctcgcttcatgtgcgacagaggaaatagaacaaatagaaattcaaccgacagatggatcaatggtttctctttcattctctgtagatgctccgaatgctcttgagattacgaaagcgaccggggatgtggagaaaggtgttgagtccttatatctatatacatttaatgaggatggagagtttatctctccagttgtagaggctgttgtttctggcaatggatatacggcttctatctcaaaagagacccgtaccatccattttgtcgccaatgatggaacgttaaccccttccctagaaagcggaatggcctcgttaggaacagataagcaaatcttttggggaaagagaacttttagtgaaattcctgcgaaaaatataagcaataatctagaagatgctggtaacaacaatgttgaactactacgaaactgggccaaaataacgctgaatctctcatcggaggcagctgtgaaattgaaaaatgtttcttatctcatttataatgaatcacagttggcatctatcggttataaagatgcgggaaagttgaatattccaaatcaagatttttatgcgccccagaatgagccagatgctagtaaatatgcgaagccgggtgaatctgtgtatacttttgaacattataatcaagataagaaagcgacttttgttattattaaggcgcaatttgatggtagcgagacctatacatattataagattgatcttgccgtaaaggatgagaatgataaggtaactcgtgtttatgatgtcgttcgtaattatgcctttaatataacggtcaagagcgtttccagaaaaggagctacgtgggctgaggttatagatgaaaatgtgatagcggataataatatcacggcctcggctattatggaaaagtatccgaatataacttatgatggcgaggccttgaatgttacaaagacgacattcgtttttacgggctcttctaacacattgtcgatgactgcgacatatgcgggaacagggcagttgagtgtggttccgggtgagggaatgtcggatgtcgtagatggtaacttaagttatccttcttggataccttctggcaatcagacgataacgattacagccaatataaagccggctcctgactccggtgagaagatagcgtatttctacgtggtaggaggtaatttgcagcgtaagattaaattggtcttacgtcccccttatgactttattaatccgagatttgaagacgtgaaggaggggacgggtacaaatgaaattgccgcaggtcagaagcaagatgcttatctgaaattctcgataccggaagatattgatgaatccttattccccattgaatataagatatatactaaaaaactgtatgcagtagaacccggtgttcgtttggaaacgaccggagcgagcgattggtactacgtctatacggatcagatatttagtcctgaagagaaggttattcattttaaaacaaatacagcaaatgatgatgaagatgatgttattttaaaggctgatttattcaatcctgtttctgatttgagttatactagacctgaaaaagttaaagagacgaaaactttctatttgcaatgtcgaagaaatggaagcaatgtgggaagtaatgtaacgatcacttattccatatcaagtggtggaggagcagcaattagaactaataatagctctaaaataatattggataaagtatccgtgtatgcagatgatgaaataacgtttacacacacatcttggggaggtacgtatactgcgaaaatgtctgtatctgatttggcgaaaagtagtaccagtaattatgtatttgtggatatgagataataataacgggttcccatccatcatgtgaataatggatgcggggagcgtgcagcacacaatggattgaatttgttttacacgtaggctgcacctcctccccggccctttacctcatatagcattcgtgcttcatcgatgccattcattccgtaaggagatgggcggcatcgctttcttcatttgctgatgaagttaacttgctttggtctgagatcaaaggttcttgcgtaaaaaattgcgcaaccctttgtttattaaaaaaaaggctctatctttgcagcccgaataagtatgcgaataataataaataatatagaaagatgaaaagaacattccaaccttccaacagaaaaagaaagaacaagcatggcttccgttctagaatggctaccgctaatggccgtagagtattagcttctcgtcgtgctaaaggcagagctaaattaacggtatctgacgaatacaacggataattagtcacgttctaaagatttataaagaaagtagaggttttttcctaaaaagcctttactttctttgtttttgtagtattgttctggtgggtattggtctatatgccgttttttttctacttttgaaccgcctacaaatacatacgtgaaatgagtaacttttttgtaaaactgataaagaatccgtttgtcatcaatctcttgttggtgatagtcgtgtcgtgcggcgttgtttatggcgtactggcgtggctggattcttatacccgccataatcaagcggtggtcgttccggacgtgaaaggaatgaagctagaggacgccgccgagtttttcgggaataataagctacgctataacgtgatcgattccgtattctcgaaagatgtggctccgggctccatcgtggagttggttcccggtgtcggatcgaaggtgaaagaggggcggatcgtctttgttacgattaacgcattgacctcccagatggccgtgataccggaggtggaagacttatctttccgtcaggcgtatgccttgctgcgggcccgtggcttctcgtcggtcgagatagagtatgtgccgggcgattataaagatttggcgatgggggtggagttaaacgggcgtaccttgctcaaaggggaacatgtaccgttgaccgctcatctggtattgaaagtaagcagtggcgatccgaatatgcttcccgactcattggctttggatagtattccggtagaaccattggatagtgatatagaaaactggttttaagggaatggacgagtttttggacgatatggatgatgaacaggtagacgacctgttgatgccggaagaagacgaaacatcgtcgagccagatgtatgagcatttccgcttcgtagcggacaaggggcaatccctgctccgggtggataagttcttggtagaccgtatgatgggcgctacccgtaaccgcatccaattggcggctgaggcgggttgcatcttggtgaacgataagccggtgaaaagtaattaccgggtgaaacctttggatgtggtttctatcgtgatggatcgcccacgccgggaactggagattatccccgaagatatccctttgaatatagtatatgaggacgatgatttgctggtggtgaataagccggcaggcttggtcgtacatcccggccacggtaattatactggtacattggtgaatgccttggcttattatttgaaggatgatccctattatgatccttccgatcctcgtttaggcttggtacaccgtatcgataaggatacgtcgggcttattggtggtggctaaacgcccggaggccaagagtaacctgagcctgcagttcttcaacaagacaaccaaacgtaaataccgtgccttggtatggggcatcgttcaagaggatgaggggcgtatcgagggaaatatcggtcgtgaccctcgtgaccgtatgcaaatgaccgtcttcccggaaggcgatcaaggcaagaccgccgtcacccattacaccgtgttggaacgcttgggctacgtgagcttggtggagtgccgtctggagacggggcgcacgcaccagatccgtgtacatatgaaatatatcggtcatacgcttttcaacgatgagcggtatggcggacatgatatcttgaaaggaacaacttttactaaatataaacagttcgtgcaaaactgtttcgctatttgtccacgtcaggccttgcatgctaagacgttggggttcgttcatcctactacgggagaggagatgtttttcgattctgagattccttccgatatgcagcagctgatcgacagatggcgtgtatatgcgaacactaaagaattgtaaaaatgaaaaagaacatcgctatcgtagcagggggagattcctccgagatcgttatttcattaaaaagtgcggacggaatctactcttttattgataaagacaaatataatttatatattgccatcgttaagagggatgagtgggcggttatacttcctagcggggaacatacaccaattgataagaatgattttagcttcaaggagaatggcgtgacgaggcattttgacttcgcttatataacgatacatggtactccgggcgaggacggacgtttgcaaggatatttcgatatgatcggtatgccttactcgtcttgcgggatgctggtgagcgctttgacattcaataaatacgtatgtaatcattacttgaaagactttggtgtaaaaattgccgcgtccattcatttattcaagggagagactattacggacgaagaagtcgtgactcgtttgggtttgcctattttcgtgaaaccaaacgatgggggtagtagttttggcgtgacgaaggtgaaagaggtctccgctatccagcccgctatcgctaaggcgtttggggaaggacgtgaggtgattctcgagcgctttatcgatggaacggaagtgacatgcggttgctataaggtggagggtaaagaggttgtcttccctttgaccgaggtggttacgaataacgaattcttcgatttcgacgcgaagtataacggacaggtggacgagatcactccggcccgtatctccaccgagttgacggagttgatacagcgcgagacatcaaggatctacgatatattgggcgccaaaggactgattcgtgtggattatattattccggcagacggggagcctgtcttactggaaataaacacgacaccgggaatgacggctaccagctttatcccacagcaagtacgtgcggcgggattggatataaaggatgtcatgacagacattattgaagacgaactcaaaaacagaaaaacaaaatgaatagatatggatacagaaacagtttcccctaatttcgacgacatccgtccgctgaacaacagtgaggtgaaggacgcgattgaaaaattggtcgccaatgaggatttcgagcgggctttacgttacataaagccgaatttgaattgggaggaattctcagttgccatgcgtgcttgcaagacgaaggaggagtttaaatctactctggcctatgacgctgtaatgacggtggcgaaaaatactactttctcgcttactatctcagggcgtagccgtctgccgaaagataaggcggcctgtacgtttatctcgaaccatagggatatcgtattggatgcctccttcttgaacgtcatgttatatgatgtggggtatggtatgacgcaggtcgctatcggcgacaatcttttaatccgtccgtggatcgagacgttggtgcgcttgaataacagctttatcgtgaagcgtggcgtttctgttcgtcagatgttggaggtcagcaagacgctttccgcctatatccatcatgcgatcaagaatgtgaacgagtctgtatggatcgcccagcgtgagggacgtgctaaggattcggacgatcgtacgcagggcagcgtattaaaaatgttgagtatcggcggtgataaggataatctgttgttgaatttgatggacttgaatatcgtaccggtcgctatctcctacgagtttgatccttgcgatttcttgaaggcgaaagaattccagatgaagcgggatgatccggattacgtgaaatgtcagcgggatgatttgttgagcatggaaacgggtatcctgaataataagggtcgtgtccacttcacgatcacttccccgatcaatgattccttggctaaactagacaaggatatggagaagaatgagctggtaagcgctatcgcgtccgttatcgaccgggagatctataagaactatcgtttctatccttgtaattacgtagcttatgattggctgaacggtactcgccgtttccacgagcattacggaccgaaggataagaagcagttcgaggagtatatacaaggacagttggacaagatcgtccttccgaataaggatgaggcgttcttacgtaagaaactattggagatgtactccaatccgttgaagaactatttgacaactttataagttccaattgattttgatagagaggtgttgtaaaagagcggaagaagccttttacaacacctttttggttaaccgacgtatctacgttcataaatacctgcatgaatgtatgtttcttaacatacgctttcggtgacatattgtaatcccctatttcgtatctttggcatatacggtaagaaacgcttacagtatgctaatcatttaaatcagtagcagtatgaaaccggaagattacatcacccgtgaggagaagtatggtgcccacaactatcatcccctgccggtcgttctcagaagaggcgaaggcgtgttcgtgtgggacgtggaaggaaaacgttattttgatttcttgtccggatattcggcgttaagccaaggacattgccatcctaagatcgtaaaggccctgatggagcaagcggagaggcttacgctcgtgtctcgtgcctttcatgctgatatacttggtgaatacatggaatttacttgcaaattcttcggctatgacaaacttctgccgatgaatacgggagccgaggcggtagagacggccttgaagctttgccgtcggtggggatatcgtcggaaaggggttgccccggaacgtgcgaagatcgtggtttgtagcgagaatttccatggacgtacgattacgattatttccatgagtacggaccctagctcatacgccgatttcggtccttatacacccgggtttataaagataccctataataatgtggatgcgttggccgaggccctgaaagatcctgatgcagtaggcttcttggtggaaccgatccaaggtgaggctggggtagtggtgcccgacgatggttatctgcgggcttgctatgatctttgtcatcaaaagaatgtgttgtttatcgcggacgagatacagacgggtatcggccgtaccggtaagttattggcttgcgattacgaggggattcgtccggacatcttgatcttgggaaaggcgttgtccggtggggtcagtccggtctcggcggtattggcggacgatgagatcatgcttacgatcgctccgggagagcacggttctacgtatggtggaaatccgttggcggcgaaagtcgctatcgcagccttggaggtggtacgtgacgagcatttgtcggagaatgcgtttaagatgggtgagctgttccgtggtgagatggagcggattaataatcctatgataaagaaagtacggggtaagggcttgctgaacgctgtcgtgacggaacctaaagatgggaagacggcatgggacatctgtttggcgttgaaggaaaacggtttgatagccaagcctacccacgatcatatcatccgcttcacgcctcctttggtgattacggaggagcaaatgatggaagcgattggcattatacgagatacgttcgctaaattctagtgtatgaagataaatgtaataggtgttcccttgaatctgggatgtgaccgggctggcgtagagcgtgccccgaaccaccttcgggaacggggattgatgggggtgatccggaagaacgggcataaagcctttgacttgggtaatttgtatgtaccccctgttagcgaggcggataagttcgtacggggtaacagcatgaaatatctggatgcgatcgtggaggtaaatacgaatctggcggagttggtttatgatacattgcgtggaggagcgttccccttggtgattggcggggatcattcgctgggtttaggtagcgcctcgggcgtgggtaaatgttatgatgatttcggcattatctggctggacgctcatggggatatcaataccagcgagacgtcacccagtggtaatatccacgggatgcctcttagcgcattgatggggatgggaagcgaggagctggtgaatgtctacgcacccgggaacaaggtgaacccgcagaacgtattcttggtcgggacccgcagtctggatgaaggcgagtgggatttgatcgagcgggagaagctgagtgtctatacgatggagacgatccatctgaaaggtatcggcttcgttgcggaggacatcaagcggaaattgaaggaacggaagatccgcaacgtgcatttcagcatagacgtggatagcatagacccccgtttcgccccgggcacgggaacccgtgtgtgtgagggactgatgccggatgagtttaataacttcgtggatcatatgctatcgacaaacttgattaaatcgatggatctggtagagctgaatccggaattggatgtgaacgagcagactacgagcctttgtctgcagatcattgattatattaccgcccgtctataaggaatctaaattccatggtttatgataagagtgtgaaaatgaagtccccttgtcccggttcagaccggatacgaggggacttgaaaatacgatatgtctatcggtttatttcatttttcggatattggcgtaattgaagctatcgctcaagaaatcatcttcgctgaatttatagccttgagggccccagttgcccatagcgagcatggcgatcatcttcatcggattgaaaccgctcatatcgccgccggcggccgctagaggaacggactccatcagcttgcgcatggaatgtggataattctcgttgatcaccatgttgcggtataaggcaaggattccatctccttgctccttacggttccaagtcaggatatatgtaccgtcgttggcttctgctttcgcttggagatcgggtagtttggcggagttggcgtctgctatgataaaggttacgaaaccttccttgtccactttaggcatttctttgtcgtaaatagaggcatacgagtaggtctcggctgacccaaggcatatggaccagtatcgtacatcggcggtggcgtattcgcttacgcttttaggagccgtaggagggatgaaacggaaagtagctacctccccttcgttcagtttgatgcgggcgaataggtattctgccgggctgttcgggtacattaggctcagcggggcacgcatgaacgggagttgcggcaggtcggtggagaaatccatcggcggcaagttcaacgattcgtggatgttgcagacctcacgcttcgggaaatccacttcctcacctgtagtcacattgaaagcttggatagcaggcatgtccacgccgccatactcatcgccgctatattgtttcgccaagtaaagacgcatgaaaatggagaccatattgacatcttccggaaactcgcatatgttcttcatcgaagcacgtgcgctagccggtgtgttagctggaatgatatagatcgtatagccatttgatgcgtaatcgtctgtctcctttacgtaggggttgatagagctgtcgtcgggttggatatttacgtcctcgatgctggatacgtctatctgggtctcgtcgttataaaccgtgaagttaaagaagcgtgacttcgggtactttccggtcagacggaggccgatgtttggattatctttgtaagaataggtgtattcccaataatcggcatagatatcaggaaaggccagtagggtttgattgtcgccccggagcgtcttgccccattgttccttgggttccgggttgttgatttgaggggtattctcatcattgtcatcgcaagcggtgaacatacccatagtaagggctaccaacattaagtaaaaaatcttcttcatgattctgttcgttaattaatctgtttgttattaaaatgagagcgcaaaagtatctcatttccaattagggttgacctattgaaaatgaaataccttggataagaccacagaatcctaggaatggaacagctagaaggggtatccgatagcgaaatggtaacccatgccgtccttgaatttcgggatattgtaatagcctttctttccggtatcgtaagggaggtgcaggccgatacccacgtcgaaacggatgacgataaaggtgaggtcgtaacgcaggccgaagccggttcccaaggctagatccttgaggaagctaccccatttcagttgtccgccgggacgatccggatcgtttcggatcaaccagatgttgccgctgtcgaggaaggtagccccgtggaggtcgccaaggatcgggaagcggtattcgagattggcctcgaatttaagatcacccgtacggtcgatgtaagcgtatttattgttgtcgctgttctggtagtagcgtccgggaccgatgctgcggatcgtaaaggcacggatgctattcgctccgccgatgtagaattgctcgttataaggggaggtacgggcgttgccgtaactataaatagcgccggccattaatcggcctacgagatattgcttatgcccgagggcgtaattataacgtatctcggcggttcccttgatgaattgggcgaaggggttgccgagcagttccttatcctcttgattgaacttcttcccggctaacgcataaatcccatccaagacaaggcccgcttgggtaacggatgcctgccaccaaagatggttccggcgactggtaatcggggaatcatcataggtataggtatagttcatggccgggatgaattgattttgcaaactcttctttagggccttgttcacgttggtaatgctgtcgaactcatgcgtggtatgctggagcaagttgaacgtcagcttgaaaggggtgatggaatgatgagacgtggcggtaggctggaactcatacgaggcgtcaccaccgaatgccagcaacttgaagaaacgggcccggttcatctggtccgcatagaggcggaaggtggtgctggccgggaaattcatgtcccgtttgctgaatgtagggaacaatacccgtgggaaagtcagcgtggtagtcaagcctaactcataactgttgatcttggagttgctgccatccagcttgttgccggtctgccattcgtaagagccgcggagtttcacgccgaaggtctcgccccctccgaagacattccgtttggtcacgctgaaaatggcgcccggacccacttggtcgttgctcttggcggtaacgttcaactcgagctcgccgtccaatggaagatcgtagaccgtattgatccgcagatccagcgtatcttgacggcgcatggtatcacggggggaatattgcaactcggcataacggaagatacccaagcgggacagggcggtttgcgtccgttcctgcgcccgctggttgtaaagttcccccggcttgaaatataaacggttgtaaatgaccgaggggcgaacccttagcttgccctcataatggatcgtaaggtccttatagcggatcgagtccgtgggagtctcattctggtaaccgtttagccagacggatatatccccgagcttccaagggcggagggccgaggggggcaggctttccttcggggccacccgtaaggccactttcccggggttcaacaaggtatccgcttgataggtgatgaaatcgggacggaaatagtaatagccgttgttacggagcaaggacgagatgcgttcccgctcggcttgcaactggacgacattgaaattctctcctttgtggaggatacgatcgccgatcgtggcatcgatcaatgagtcggcacggtgacggatatggacgtattggatgctgtctagcgtatacggatcgttcatggtgacgctatattccagcttcgccttccggggattcttgggatcgggtacgacctcgaaagaggtctctccattgaaataaccgtattcgttcaataggttccgggctaccttgacacggacttccgggttcacggtggtgatcagcaccggtttcgacgccagcttgttgaagatccacttgccgaccttccctttcttgttcacgaaagcgttgtagacccacaggccgaaggggaagggcacccggatcgaggagcttcccagcaaggcgttgttggggggataggctagggcggcctcgacctcttccaaggcggcttcgccgggtttggtcttatcctcgttcttcacctctattttcttgataccggtatataggaccgctccctcgggaaggttcttcgtggtggagcaagaggtgagtaagaaggccagcagcccgagtagcgccagcgacgataggatcgctctttgggtagacaccccccctcgccctggggaagtatccttccctgctttgggaaggcatgtttccctgctctgggaaggcatgtttccctgctctaggagggcatccttcctaaaatatattaaaacatttttcatattcattccttttctgtttcctctttcactggtttcactttcgttttcttgaagttgaatagctccctgagatgcatcattttcttgcggagcacgataccggctccggtctccgtgatctcgccttccagcaggctctcgtagttcttgtcgtggaaaagtttgacgtaacgggagccactgctgtctaaccgatattctacggatacgttatcgatgaacggctgcgcctgtccattgttaatgttctcgccggtagagatacggccgcctagaaccacacggatacggtcattatagaatcgcttggcgaagcggaaggagtagtcggtacgggtaccacctccggcgtcgccattatcgtcgtacgtctccatgccgaagctgatatccacggatttcaaggcacttccggcgatgttgttgatctcgctttgcaagaagctggtcaaggcgtctcccatatttacgttcaccttgccgccaccaccgcctccgccgaggtacataccggtcacgagcatgctgacagccagcttcgcccgttcctccgggccttttgaggtcagttcctcctgcatcgccatgtcttccggggcggtgagggtaaattgcaaccctaggttctccagttgttgggtcagttcgatgcctacgtcgaaattcaccaagcggggcgatgattgcccggttagggtgacggacgtacggactcgctcggtagccgtaaggttcaaggtcgggtccatggggttgcccgtccattgcacgtagctaccctcttgtacgttgaactccttcaatgggatcaccgggatggagtacttgatggttcccccggatagcgtgtagcgtccgttcaagaacatatcgccttgcggggtatactggaaggaaagatcgccgccaccctccagattgatatggttggactggtcgggacttaaatccacgttcgcttgtacggcgggatcgatgtggatcgtcatcagcatgtccatgcctcccatcggcaacgggggtttacgaggcatgcgccggcgtaaggtatccgtgaaagaggtgaaggttaccatgtccgacatacggtcttgcacggtcagcggggagtctttcagcacgtaggtgatattcgtcccgcccaataattgcaagtcgcctcgcatggtcaaggcatccaacggcccgcgtacggtagaattcaggttgacgaacagctttccgtagacaaggctttcttcgtttttcttaacgttcagcagttgcaagttattcgccgttagtttaagattggcggtcatgcgggataaattgttgaaatccacttctccgttgatgataaacggattcttgttgtatgcgtaaataccatattggttgaacaagatccggttgttctttatttctatctttttatcgtcgaaacggaaggtagaacctgcggcgcctacataaacggaggcggtatcgagaatcagatatccctcggccatgggtttatcgctttgtccgctgatagcgagcgtaccatcgaggtctccgcccattttcgccatatcatccggaatgaacgggttggcgatatccaaggggaagtgcatgaactcgacagtaccgctgatatggtcggtctcgcccatctggtataaggcggtaatggcactcacctctttccggtcccggaaaaggtgcatatccacttgatggttcccctgctctaaaggtagatagactgcgttgaacatgagttcgccgacccgctcgttctcataatacagatcatcaatgttcatatccgccacgaccatgaaggccgagtcggaaggagcgtactggaaatcggcgttcaatatacctttcatcggcgggatatagctgaatgcgttggagataatcccaaggtcgatctggttcaactcggcgtggacttcctccatctcgtcactttccgcttgggagtgtatccacaaggcggcgttattatctccgctgagtcgcaggttcgcctcgatatccttcatgctgcgtaccacgacgtaattatccgggttcagcttgaaagggcggaacgctatgatcgggtcatcggggaagagatggaacttgaccccgttctgtatcttatcggcccggattccgagcaacaagccggtctcgcctttcccgtccttgaaataaaggcgggcgtcgccgaagtcataacgtatttgcccgtccagcccggcgctgaaaggttgttgctgcctgtatttattcttgatcacttgggcgctatagagtaatccgagcgaatcttggtgcatctctgcccggatggtatcgatctgcatcgtatcccgtgccagatcgtaaatggaggcatccatgcgtatacccgtttccggtgaggtataggcgttcatggcgatgctcttgaaatctacgtaataggtttggagatagttgtagatcggattgtcctgtcctgcccgtacctcaaggtacatatcggggaggagcgggcgaaggatctccagattgacagtcgagtcccgttccaattggagggtgatatcgttcgataccttagtcaacttatccgtgatgtggtgtatgcaatcattacccgtgaggatgatccctaaatccccggcgtggaaagacacacgggtggtatcgatatccgtccgggcatgcaaggtcagcgttttcggcttgaaactttgttttggggtgacgacctcccagtttcctaacgtaacgtcgatcgtgttatcttcatccagattactttctacctctgcgaagagctggaaagaggtggcgaagggatttgccattaagtgcataccctgtaaatccatgttctctacatccgctatcaacatcgctttcacctcgtgcttgtggagggtcgcgtttaaggagacatccattttcgccaacgggtatttgctaagcaagtccactttcagtaagttcttttccagagagccatcgatggatacgtctgataccgatgaggcgccatagcgtatatccgatatcttaccgtccagtttggcccatgtacgttcagagaaagggtctgtgccccggccttctgctttaacagaggcggtcagccaaaatagagagtctttaggcatgaaatgagtaggttccagactgtctatccgtaaattagcctcataagccagttttaccggattatagcgggcggtcagacctactttgcctttatcttgggtaagaacaagctcggtgcggtattcttgatttgcgactgtagcttcccccttcaactgaattcctgccggaatggcaaattgatcccgttgggaggcgggaagcatcgccagcaaaaagtccagattaccggatcgagcgtttaactgaatctcaccggttcgccggatgctatccgtcacggactccatgctacccgtgacgttcatctgaaacgctcccggcagcatgatatcgccttgtgtgatacgtatactggagaggttgccttctacgccagccgtaatagcgagaggcttgtccgggtaggctttcttgaaatcctccggaagagaacctgccgctatcaataaatcctctttccccaacgaggcgtttaacagggctttcatgctaccttgcggatgatcctcgagggagctccaagggatagtcgctgtcaatctcacttcggaatttggtgtctggagaagtagctccggtacgtctatctgttcatggtcactccggacatttcctgctaatgccgaaaccttgaggccggaacgttcttccacgaagaattccttgatgtgggcgtttatttcttttccttgatataagatggaatcgatagaagtgttcaggttcgttaaactgatatgggagaaatcgagtccttgctcgggtgccgcgtaattcccgtcataagcgaatgtagaattcgttatgtcaaagtttctcgccttatattgttccgctccaagatctacgaggccgttatttagcccggctttattaacgaaagccgtaaggcgtaaggaatccgagggcatttgtagggcgaaggctacccggtccaaactaattttatccagcttgagtacccagttcagaggtgtggaagtcgtgtcttctttcgaggttgaatcatttaatagaagggtaatggcggtatcggataaatctacggtattaaatgtagctttctcctcggacaggtctatacgatcggcgtgcaggtaaagctttcccaagaatcctttgatttccataccttcaatcatagtcccggtgttaacctttacgttccggaggtcgatcgcctctaccaatacttgcttccgcaaaagaggaagggcacgaacccgtaccgtcaagctctgtaaactcaacaaggtatcggcgggaggatttacgacctcgacacccttaaccgtaaggtctaacgggaaagatagcctaatctgctcgatcccgatttgcataccagtcacttttcctgcgtattcggtcgctttccgtaccgcgaagttttggaaaggaggtatatatagtaatatagagagtaacaataccaatgcgatcggtattaggcatatcactcctatccgtttaatccatactctcatgttgatacgtttctctttttcttatttgtttatttgcctgtttttatgacgatcgctccgttcgcgcctctcaccccgtattcacctgcgtctttcaatacttttaattccgagacatcttcaacgggaatcgtgtttagaacagataggtccatcggtataccgtctaccactactagcgggtcactaggactgtttagggaaacgctcgcacggatgcgtacggaaccatcggcgaatgttatgccactcatccttcgtagcaggcaatagagatcccggcatccggttttctgtatctcttctttattcataacgcttgagcttactattttgtttcgttccctttccataatttctttcagggcctcatccggttcaaaactacgctctgcgttgaatgtgctattctctaaagtaatggttatataattgtatccgttgactgggactttgactacatttcttgttttcttaatagtgacgaacaaggtatcattcaggttagcccccgggatggtgaatacgccatgtttgttcgttttcacggtgatcggattctgactgcctagcgtgaccggatagcgtttgattattttatcgctgatgtcacgcaatacaccgactaaagtatcattctgtgccaaaagtatttgactgctgaatgataagatgatgattgaaagataatgtattgttttcatagctcaatctttttagctgaacataacacaaagataatataatatttcttaaaggcagagttttagggcaaattcgtaataggtattatttttacgtttctatgtggtctcatttgtcgctaaaatgagattactataaatggaaatcattacatttgccaaaataaaatgaacggtatggaattagatttagcctatttgtgtaaggaggttcgagaaatagctcgtgcttctgcgacattcttaaaagaagaacgccgaaagtttgaccggaacttagtggaggaaaaaagtgctcataactatgtatcttatgtggataaagaatcagaacgacagatcatagaggctttgtctactttgctacccgaggccggttttattgcggaggaaggctctggaagtttgaccgatgaggaatattgttgggtaattgatccattggacggtacttcaaactatattcatgatatcgcgccttattgcgtgagtatcgctttaagaaatcggaaggagttattgttaggagtagtctatgaggtgtgtagggacgagtgtttctatgcagtgaaaggtggtaaggcttacttggatgggaatgagatacatgtatcggatgtctcagtactggataacgctttcattgcgttgggtttcccttataactctgatgcttatcgtccggtagccgctcatttggttgataggttgtatggttttgcgggaggtacccgtttgatgggatctgccgccgctgaactgtgttatgtggcagcaggacgttttgatgcccgtatagaagcctatttaggcccttgggacgtagccgctggtgccttgattctattgcaggccggaggaaaaatatcagatttcaatggaggagagaactgggcttcgggtgaacaggtagttgccagcaatggcaaggttcactctcttgtgttgtctttgttgccctaatactagagtaatcctgcgtattctagtgcttctgtgtgtatttaaaaggtaaaagagtttaaacttacttcttatttgcggggtgtttgatccgttttgattttcaaaacagatggaggaatacaaatacccgtaaatccttgtatgtgtctaattcagtaaaaatcaagacttttaggattagagattttacttacatttgtggaaaataaaaatgttacagagtatgaaaaacaatctatacgtcttttttctgttctttattactggactaatgtcatgtagccatcactcaggtctatatgaacatgcggaaaagataatgtcccaacatcccgatagcgttttaacattgctatcaacaatacaagatgtaaatgatctttcagaaaaggatcgtgctatgtactacctacttttgacagaagcggaagataaaacttataagaagcacgagtcagactcattaattgcaatagctacagaatattttgataagacagatgatgtgaaaagaaaagcaaaagcttggtattatagaggacgtgttgttgatgatttgaaagatgctccacgggcgcaggattattatttaaaagctttacaaaatgagatggagattactgattatgcttttcttggacgtttatataatagtatagggatgctttatacctatcaagaagtatatgaaaaagcggttctttaccaaaaaaaagctttatattgtttcgaagccctttatgattcgattgggcaatcttatgtactgagagatattggacggaacatgacagctttaaataaaatggatagtgctattttttattatgaaaaggcgttatacttttgtgatcagaagagtaaatcctctgtatatagagaattggctaatctgtatttagatattgataattattcaaaagggctagagtatattgagaaggtcttaagttctcctttaaaaaagtcaatgttagattctttttattttgtgttagggaaatattatcaaaaaactaaccaagttgattcagcgtattattatttaggatatagtagcaacagctctaggttacaaacacaagctgcagcttattatcatttagctcagttggagagattccgggaaaattggaaaggttatgcgaataatcagattagatatgaagttttaagagattctgtaaaccaaacaaagaaaacggaatcaataagacgaatagagaaaatatatgattatcataaaacagaagctaaactattacaatctgaagtcttgttgaataagttgaaagtaaagaatttaactgtgactttaattttaattataagtattgtcgtgattgtcgtgatatcagttttaggatatgtgcagatgaaaaagaaaaagttgcgtttacaagagcatagggagctattacaggctctagaaaaaaaacaccaagcagatctgactcgcattgaggaaaatgaaaaacttattagggaattagaagaaatgttgcaaaaatcatctagagcttacaatgaaaaagagaaagagttgatggctcttcaaaaaatgaagttggaaactgaaaatcagaatttaagatatgttaaaactgaaaatcggtttttaatagagagttttcagatgtctgatatttattataaattccatatgaaagaagaatggagacctaaagaagaagattggaatgaattatttaaggctttggatgaaacctttgataagtttacacgacgtttgatgactatattctcaaggttgacaacaactgagttgcgtgtttgttgtttaattaaagctaatgttcctccagtaacaattgcgatgttgatcgtaactactccaacaaatgtatcaatgataagaaagcgtctttatgagaaaatatatcctcaagaaaaaggatcttcagaaaagtttgatagatttatccgagagtatttgtagtaaatgtgcatattttgtgcaatagtagtagttgaatcactagcaaagtcattgtatgtttgttgcacaattaatacacaagatattatgaaaaatgtgaacagatttattttttgtgcaattttttttgcgttatttttagttcaatctgtatttggagatattattccaacagaaggagcttgggatgatgaacgttatcgttccgttaacacaaaccgtcctccagttgcatcaatcgaaggagacatcctttccttgagctttgaagatgctttatcaaacttgaccgtatgtgtcatgaatgatgaaggagtgaaagtctatgaagatgttgtttcttcagaggcaggtggaacttattctttctctttagcgggagaagcaaatggccagtatcaggttgtgttgttacatcggttgggacacttgaccggtagctttaccttggaataaaaaattaagaggttttgtaagaagaaagagctgttgcttctcggtaaaatgggaagcacagctcttttttatttggacaactgtaccatatacgaacctttacttgaaaacgtatctatgtacatgttttaccgctaaacgtatcattaatcagccgggagtcattctgtttattgtatatttcttgaaaataggcttcattgtagcctgctttactatccatagaaatagtgattagtattaatagaaattcaaaatactatggatactaatcggagcttggatagatacgattttattgtatgttgattattaggtgtataggtaatagtttggaaatattagacttattgtgctttttaagagatcaaatttggtgtggttgggctatttttatttccaagtggtgttatttcatgactatattataacttgaaaaattcatagttatgaaattcacaactcataactatgttttaaaaaaaacataactatgaaattttataggatttagctgttaaaatcaatatggatttcccccttgtctaagaaatgacaggacaatactattatatatgccgtttattctgtatttttgccagaaaaattagcagacatggctgaaagcaaagttgaacacctattggatagcattcattttccggaagacttgagacatttgtcacaggataagttggagcaggtatgtgccgatttgcgtcaatatattatcgatgttttgtctgagaatcctggtcacctaggtgcaagccttggtacggtagagctgacagtcgcccttcattatgtattcaataccccctatgaccgtattgtctgggatgtcgggcatcaagcttatggacataaaatacttacaggaaggaaagatattttccatacgctccgtaagtttaaaggaattagcggcttccctaatccggcggaaagcgagtatgacgcttttatcgccggacacgcttcaaattcaatctctgcggcgatgggtatgtcggtagcctcggccttgaagaaggaactggatcgccatgtgatcgccgtgattggggatggcgctatgaccggaggactcgccttcgaggggttgaataatgcgtctgccaaccctaataatttgttaattatcctgaatgataacgatatggcgatagatcatagcgtaggtggtcttagccagtatttagtggatataacgacgagtcaagcctataataaaatgagatacgatgtgtatcgaggcttaaagaagatcaagctcatcaataacgatcgccgggaaaacatcttacgttttaacaatagccttaaagcattgcttacccagcaacataatttatttgaaggcttcagcatccgttactttggtccggtggatgggcatgatgtaaattatctggtgaaggtattgaatgatataaaagatatgcaaggccctaagctgttgcacatcaaaacgaaaaaaggaaaaggctttaaacctgcggaagagtccgctacggaatggcatgctcccggaaagttcaataaggaaaccggccagcgtattatcgttcgtaaattagatgagcctcaattatatcaagacgtattcggtcatacattggtagagcttgcggagaatgatgaacgtattgtaggcgtaactccggctatgccttccggttgctcgatgacttatatgatgaaagccttcccggatcgtgcgtttgacgtgggaattgcggaaggacattccgtaactttctctgctggattagctaaggagggaatgatacctttctgcaacgtgtattcctcgtttatgcagcgtgcgtatgatatggttatccatgatgtagctttgcaaaaactacatatggtgatctgtctggatcgtgcgggattagtgggagaggatggagctacacatcatggcgtgtttgatttagcatatcttcgtccgataccgaatttggtaatcgcttccccattgaatgagttggatttacggaatttgatgtatacaggctatgccgcttttgatggcccgttcgtaattcgttaccctagaggtaagggggagatgaaagattggcgtaacgagatgcaagtattgcctataggaaaagggaaaaagttgtgtgacggggatgatatcgccgtactttctatcggaccgatcggaaacgaggtgatcaaagccatcgagatggtgaaagaagagggggtatcgatagcccattacgatatgatctacttgaaaccgttggatgaggagctgttgcatgagatcgggcagaaatataaccgtattattacggtagagaatggagtgataaaaggaggttttggtagcgctgtccttgagtttatggcagacaatggctatacgcctcatgtaaagcgtatcggagtgccggatgcgtttatcgagcatggttctataccggaactgtatcaattatgtggtatggatgccgagagcatcgcgaaacagttgaaaaaggagaattgattattgtcaattaataaaatatgaaaattgtcatagccggtgcgggagaagtaggtacacatttagcgaaaatgttatctcaagagaatcaggacatcattttgatggatccgaatgaggaacggctgaatttctcaaaatctagcatggagattctccctatggtcgggaatccgacctcgcttagagatttggaggaggcggggatcaagaaagcggacttgttcgtaagtgttactcccgaggagactaccaatgtgacggcttgtatgttggctcataatctaggagcgcatcgtacgttggcccgaatcaataactacgaatatttattacccaaaaataaagagctgttcgagaaactgggaatcaactcgatgatttaccctgagatgttggcggctaaggagatcgtgacagctgtacgccgtccgtggacacgccaatattgggagctgtttgggggagctttaattctgataggtgttaaagttcgggataattcccgtttggtgaaccgggtattggccgaattgctaaatgagcagaagctatatcatattgtcgctattaagcgaaagaacgagacgataatcccccgtggtacggaccggatagagtctggtgacatcgtgttctttacgacgacccgatctcatatagaggatgtacgcttactggccggaaagaaagatccggaagtaaagaaggttattattatgggaggaagccgtatcgctatccgtgcttgccaatatttacctaataacatccgggtaaaagtaattgaggctaataaagagaaaagtcatcgaatcgctgaggttgttcctagtaatgtcttgattataaacggagacggccgtgatactgatttgttgatgcaagaaggcatcaaggatgcgcagacttttatagctttgacggaaaattccagcacgaatatattggcatgtctggccgctaagcgtttaggtgtgtttaagacaatcgctaagattgagaatattgattatatccaattggcggaaagtatggacatcggttcggttatcaacaaaaagctgatagcggccagccatatctatcaatttcttctggatgcggatgtctctaacgtgaaatgtttgacctttgcgaatgcggatgtagcggagttggtggctcgaccggattcaaagattaccaagaaacaagtcaaggatctccgtctgccgaaagatatgactctcggtgggttgattcgtgacggtgaacctatgatgatcaagggtgatactcagatacaggcatacgatcatgttgtcgtattctgcttggatacggctatgcgtaagctggaggactactttaactagttgatagttatgttgaacgtacgttttatagtgaagatgctaggggtgatgttcatccttgagactttttttatgctggctgctactgtcgtagccttcctttatcgggggagtgatgtatatccgcttcttatttcaagcggaatcttattcgggaccggttttttgttctactctatgggctttaaggcgaatgaacactcggccggccggcgggaaggaatgttgatcgtgacattgacatggattttattctctttatttggaatgttaccattctatataggaggatatatagataatgtgaccgatgcctttttcgagaccatgtccggatttacgactacaggctctactattttaacgaatatagaagcgttgcctaaaggtatcttattctggcggagtcttacacagtggcagggaggtatcggtatggtcgtattcaccgtggctttgatgcctattttcgggggtggtgcctcgcagatgtttgatgccgaaacgcccggtataacccatgaacgttttcgtcctcgtattacgcaagtcgctaaacgcctgtggggggtgtatgtttttctgacactttttttagtcggccttttatgggctggtccgatgaatttgtatgatgcggtaaatcatgcgttcacggctatatctactggtggatattcaaccaaaaacgcaagtatcgcttattggaattcctcttatatagagtatgtaataactattttcatgtttatcggagctaccaatatgacattggtttatttctgttttaatggaaatgtgaagaaattgattaaagatgaggagtttcgctggtttttcttttttgttttaggcgctattatcgttgtcatggtgtggatcttgtaccttggattcgcctcggatgtagagaatgcgttccgtaaggcggctttccaagtggtgaccttggtttctacgtgtggattcgctacggatgactatattccttggggaccgtttttctggtttatcgcattgatcttgatgtttatttgtggatgcgccggatctacttgcggtggcttgaagatgggacgcttcgttattttaacgaagaatctctccaatgaatttaagaaacagacacatccccatgcggtgattccagtacgaatgaacgggcatgtcgtatctggtgatatcgtacatcgtgtgttagcttttgtgttcgcttatattacgttaatcgtggtgagctgtttggctttatctttggatgggatgggattttcggaggcgattggtgccgctgtttctgctataagtaacgtagggcccggcttgggaacgcttggtccggtaagtaattttgcggatgttcccacggtgtcgaaatggtttctgtcttttttgatgttaacagggcgtctggagatatttacggtattaacgatattagtccccggtttttggaaacagtaaaattattgaaaatgaaaagtatacaggtcattgctagtctgctgtgtggtattctgtattgtgggatttctttaaatgcccagaatgtattgaaagcaacaggttggatgccagagcacacatttacttccggaatagaaggtccggctgtagatagcgaaggaaatttatatgccgtaaattataagaaagaagggacgatcggtattgtacgcccagatggtagccatggctgttttctcgttttgccggaaggatctaccgggaatagtatccgcttcgggaaagacggaaatatgtacgtggcggattatacagggcataatatcttaaaagtggatatgaaatctaagaagatcagcgtattcgctcatgagccaaagatgaatcaaccaaacgatattgtatttgcctccaatggaaatatctatgcgagtgacccggattggccgaatcaaaaaggccaactttggttgattaccccggatgcgaaagtctccttattggagacgaatatgggaacgactaatggcatcgctgtgagtgaggatggtaaacgcttgtacattaatgaatctgctcaattaaaagtctgggtatatgatatatgcccggatggtactttaaggaataaacgtctatttcatacttttgaggggtacggtatggatggtatgaagtgtgacgagaaaggaaatctttatatttgccgttatgataagggtactatagctttgttaaatccgcaaggagatttagttgaagagattcaattgacaggaaagcagccgtctaacttaacatttggaggacctgatcatcgtcaatgttatgtgacattgcaggatcggggttgttttgaaacctttaaggttccttatccgggaaaagaatggtaacccgatatacgtttttgattaattttgcgttataataggtacggaatattaaaaagatatatagatgatagaatatataaagggtgaaatcgtggaacttacacctacacgtatgattttggagtgtggtggtataggctacgagctgaatatatccttgaatacatatagtgcgtttgggagtaagactaccggaaaaatatatatatatgaggtaatccgggaagatgctcatttactatttggctttgccgagaaaatcgaaagggagttgttccttttgcttacttccgtttccggcgtgggaccgaataccgcacgcatgatcctttcttctctaccgccatccgaattggttcaagtgatcggttcgaagaatgaggccgcattgactgccgtgaaagggattggtttgaagacggcccagcgtatcttggtagatttgaaaaataaggtgaaacctatggagagtatggccggaaacttgccggaggcatcagtctctaatggagcggtaaccgaggaggccgtagccgcattggttatgttgggtttccagaaagcggcttcgcaaaaagcggtatccgctattttgaaaggctcgcccactttagctgtggaacaagtaattaaaactgcgcttagaatgctttgataattgacaattgaggattaacgattaacaattgacaattaaatgagaaaatgagaaaacgaatactgaaatattccatatggatcgttgtattattgtttggtgtcggcttgtattcgctgaatgctgattaccttgcgtatacatcatctttgccggaattggagttgctggaagctccggaggatacgatccctccccgttatccggtaactaaaactacaccggaggaatatcaagatatcgtgaaacaatcacctgccgatttgcgtgatccggagaatgtcaagactacgattgagtatgatttaaagacgaatacgtatattgttcgtacgaaattaggcgatatggagattggtacgccgatgagtttaaccccagcggaataccaagattattctatgcaacaatcacttcgttcctatttccgccaaaagaacgaggaagaattccaaaaagctacgaataaacagtttaacttaaccgatatgcagtttaatatcggtgcggcggaacgtatcttcggccccggtggagtacgtgtaagaacacaaggttcggccgagatcacgatgggattgaagacgaataagaataatgatccttctcttccggagcgttcccgtaaacgtactttcttcaattttgacgagagtgtgcagttgaatgtacaagcctcggtgggtagcaaggtgaatttcggaatgaattacaataccgagacctcttttgatttcgattccaagaaattgaagttggcgtatacgggcgaggaggatgagattatcaaatcgttggaagccggtaacgtgagcatgaataccagcaactccttgattaatggaggtgcggctttattcggtatgaaagcggatttacaatttggtaagttgcgagtgaacgccttgtttgcccagcaggaatctgaatccaagacggttagctcaaaagggggcgtgcagacgaagcccttcgagatcaaggtggatgaatacgacgagaaccgtcacttcttcttgggccattatttctatgataactacgataagtttatggagtctttgcctaccgtcacctccggtatcgagatctctaagatagaagtgtgggtgaccaataaacgaggtaattatgaccagtcccgcaatatcgtagctttcactgatttgggagaaaatgaatctcgtaatatcggtaatacagccttggtaatgccttccggaacggataggcgtccgaataattccgcaaacaatttatatacgactttaaccactcaatttacgggtgcccgtaagattaatatggtgaatgatgctttgaaaggtgccatggagggaggacgggattttgagaaaatcgagagtgcccgtttgctagagtcgtctgagtatacattaaacaagaaattgggttatatttctttgaggactcagttacaggctgatgaggtattgggtgtcgcttttagttttatctataatggcaagacctatcaagtcggtgagttctctacggataataaagagaatacgagtgactgtatttatgtgaagttgctaaagggcatcacgatgtcgcctgatatgatgttctgggacttgatgatgaagaacgtatactcattgggtgcttattcggtgcagaaagaaaagtttaaattgaacgtaacctatcagagcgattctaccggtacgtatgtaaactatcttccagaaggtaattgtgcgaatcaaatcttgattcgggtattagggctggatcgcttggatacttatgacaatccgaatccggatggcttcttcgattttattgacggttatacgatacaggcggagaccggtaagattatattcccttgtgtacaacctttcggctcgaaattacgggaaaaggtaggtaatgcctatgccagtaaatatgtattccaagagttgtatgactcgacattaactgttgctcgccagatcgccgagaaaaataaattccttttaagtggtgagtataaagcctcgtcgggttcggagatcgacttgggagctactaacgtggcccgtgggtctgtacgtgtcacggcaggaggagctacactgacagagaatgtggattatacggtagattacagtttaggacgtgtgacgatcttgaatgagagcatcatatctagtggaacacccgttagcgtatctctggagaaccagtctacttttaatatgcagcgaaagacgatgatcgggttagacttgaattaccagttcaataaggacttcatggtcggtgccacggttatgcatatgtcggaaatgcctcttacggtaaaaaccactttgggagatgagtctataaagaatactttatggggcttgaatacctcttataaagcagagagccagtggttgacaaacgtatttgataagttacccttgttgacattgaccaaacctagccaaatctcattcaatgcggaattcgctcatttaatagcgggacattatgagaatcaatatacgggtggttactcttatttggatgacttcgagtctacacaaagtggtatggatcttttgaacccgtatgcttggaacttggcgagtaccccctatgaagattcgaatcctaaatttccggaagcggagaaggtgaacgatatcgcttatggtaaaaacagagctttgttggcttggtatacggtagacggaatcttcacacgtaagagttcctcttcccgccctcgacatcttacgaatgatgatttatcgaatcattatacgcgtggagtcagttataaagagatctttccgaataaagagttgggaaccaatgataatacgactttgccagtattaaacctcgctttttacccgaatgagcgtggtccgtataacctggatgcggaaaatgtaaactcggacggtacgttgggtaatccggaaaaacgttggggtggtgtaatgcgcaagatcgagcctagcgatttggaatctgccaattatgaatatatcgaattctggcttttagacccgtatcttgaggacgagacagccgaaggtggtgacctatactttaacttgggtgagatttccgaggatattttgaaagatgagcggaaattctttgagaatggcatgcctgtggacggtgatatgtcgaaagttgatacgactgtttggggtaaggttcctcgcacgcaaagtacgggatatgcgtttgatgcccaaaatcgtgagttgcaagatgtcggtttgaacggtctttctacggaggaagagcagactttccctacgtatgcggattatttgaataaattgagggcgaaactatccggtgagaccatctctaagatgatggatgatccattttctccttttaacgatcctgccggggataattatcactatttccgtggggatgattacgatgctaaggagttggatattttatctcgctataaacgatataacggtacagagggaaactcacaagaatccgatcaaagatatgctacagccggaaagagtacaccggatgtggaagatatcaatggcgataatacgttgaatgagacagagaaatattttgagtacaagatctctctccgtccaaaagatttgcaggtcggtgtaaataacatcgtcgatgagcgtactccggaagtaaccttgatgaatggtgataaggagaaagtaaaatggtatctatttaagattcctattaaagattatgagaagagggttggagcgatccgggatttcaagactgtccgtttcatgcgtatgtatatgacaggattccgtaagtctacggttctgcgttttggtaccttggaactggtccgtggtgattggcgtacttatacgcaggatttgtcaaatcctcttgttccgccaaagtctgatggacagatagtcgtatcttctgtgaatatagaggagaacgggcagcgtcagccggtcaactatgtgttgcctccgggtattagccgtatgttcgattccagccagcctcagttgcttcaacagaacgagcaggcattgtctatgaagataacggatttatctcctgcggatgcacgtgcggtttataaatctaccgcttatgaccttcgccggtataaacgattacaaatgttcgctcatgcggaagcgccgattgatgagagcaagactttgtcgaatggtgatttctctgtatttattcgtttaggttctgactataagaataattattatgagtatgaggtacctttggatctgactccccatagtactattctttataatacgaacaatagcgcggatcaagaaaaagtatggcctttaaataataccttgaattttaaattggagacgctgaccgacttgaagttggagcgaaataaattgaaacgtcagggacagggaaatataagctaccaaaaggtttattcgaaaaatgatccggataatacgcgtaataaaatcagtatcatcggtaaccctagcttagcggaggtgaaagtgatcatgatcggcgtacgtaataatacgggtgatatcaagagcggtgaggtctgggtaaacgaacttcgtatgactgatttcgatgagaaaggtggttgggccgctaatgcgaatctgaacgtcgctttatccgatttgggtacggtcaatgtaagtggacgaatggaaaccgccggttttggtgcgttggatcagtcgctggccgaacgtcggatggatgattattcgcaatatagtgtggcgacctcgattgagttgggtaagttgttccctgagaaagcaaaggttagcatacctttttactatgcttattcgaaagagactacaactcctgagtatgatccgttgaatgaggatattaagctttcggacgctttggatgcggtagagacccaagccgagaaagactctatcaagagttattctttggaccagaccacgattaagagcgtctctttcaataacgtaaaggtggatatccgtagtaagaatccgatgccgtatgatccggctaacttctcgttaggttactcttatagccagaacagtaagaagaatccggagaccgaatatgagacaaccaaggattaccgaggtaatttcgcttataattatacgccttacgtgaaaccgttccgacccttcgagaagctgaagaagaataatggatatacaaaatatatcaagcaattcggactgaattacgtcccgtcgaatattagtttccagacggcgatgatgcggaattactatgagattaagctaagggatttgacaagttctacggatggaggtaaccagttgctctcattcagtcacaatttcttgtgggaccgtgccttcagtttgcgttgggactttacgaataatctgagcatgacgtttacttccggtacgaatgcccgcatcgaggaaccgaatgttcaagtgaataagaaattgaatccggatgattatcaggtatggaaggattccgtgaagcaaagtatccgtgatttgggtactcctttgaaatatgaccaaacgtttaatgtcacttggaatatgccattgcaattcataccggcattggactgggtaaatagttcattgacttataatgccacgtacaactgggatcgtggagccaatgtcgctagtattgagttggaacagggtaatataataaagaaccaacgtcaatttgactggcagggtagtttcaatttgcagtcattgtacaataagaataaatatctgaagaagatcaaccagaaatttatggcctcttcccgggtaagcgctcgtcaaccggagaaaaagaagaaagaggtgaaactagagaaagagatccaattgagcccggatagtggaacgatcgtgcagcatggaatgtttacgaagaaggttcgtatcacggcacgtggagcggacgggaaggtctattcaattaaatacaagccgatcaattacgcccaagtcatgatcttgaataaggatacggcccgtttgaagctgacaatcgtgcccggtcctcagcctttggaaggaaccttgacgaaagtcgctgaatatagtagccgtttcttgatgatggtacgtcgggtaaacatacaatattcgttgatagacggtatgatgttgagtggttacgcaccggaggttggtgatatgttcggacaacggcgtacaggaactttggctccgggactcggttttgcttttggagcggtaagaaggagctttatcgacgaggcggacgagcggggctggctggtaaagaatgagaatatgacgactcccgccatgatcaatagcgcgaagaatcttacgattcgtgcgaatctagaacctatagccggcttgaagattgatttgaacgcaaaccgggtagatacccgtagtaccgatatctattatatgcaagacggtatgcccgagcagatgggaggtagcttcacgatgactacgattgccttggggagcgctttcggcggcagcggaaacgctaataacggttattcctcgaaagcgttcgataaatttatcgctcatcgtagcgtgatcgcccagcgtttgatggatacctattctggtacggtttatccgagctccggttttatggcggggcatgctttagcgggaaaaccttatgatccagccgtagggggaggcgtaagcctgaattccatggaggtattggtacctgctttcttggcggcttatacgggtaaggacccgaataaggtaggcttgtcagccttcccgtctgttaagagcctgctaccgaactggcgtgttacgtatgatggcttgatccgtataccggttatccgcaaatactttaagagtatgatgttaagtcatcaatatcgttgttcctatagcgtaggtgcgttttcctccttcttggattgggtagatgccgggcaggatggtttgggatatatccgcgatatccagacaggtaatcctacgccgtcgtctccttatgatatagcggccgtgagtatcacggaaggattcagcccgttgtttggtgtggacgctactttattgaataatataacaggtaaatttgagttgcgcaagactcgtaacttaagcttgaatatttcctcttaccaattggtggaagcgctttccaacgaattcgtgataggagtaggatataagttgactgagtttaacaaggtgttgaaaatgaaaaagacacgcgacttcagtaatgatcttacgatccgcttagatttctcttaccgtaaaatgcaatcgttgatccgtaagattgaggatcagtttacgcaggctaccagcgggaatatcgccaagaccatccagttctctgcggattacgggttaagtcgtgccttgacattgagagcgttctatgatttacagatcaatgagccgatcgtgtccacatcttcttacccgacatcgaactcgaactatggtattagtttacggttctccttagcgcaataaaaagagtatagtctatttacaggacttcttggtctgtttttaaatacctgtctagcggtatggaataaacctttatatttgtgcgaaatataatttggatatgaagaatacttacaaattgatattatttcttctcttgataacccatgcctctttcggccaagacgtgaaagggtatattaaggatgcggagagcaaggaagctttagccggggtaaacgttttttataaggacaaagggggtacgagaggaactgtgtctgatataaacggttattatgagctgaaagtgacggatggcgacgctgtattgacttttagctatctgggatatgaaacgttgagcgttcccgtgaaagtagatccgggagagttcttgacgcatgacgtatccttgcgaacaaactcaaacatgatggacgaggtcgtcgtgagcgtcgggcgttatgagcaaaagctaagcgatattaccgtctctatggaattactgaaagcgaaagatatcactcgtcagtctccgaaagatttaacggacgtattgaagaatatctccggtgtggacgtgacggaccggcaaccttccgtacgcggtggtacgggatggacctatggcgtgggtagccgttgcttgattctggtggacggaatgtcggtgctaactccgggttccggcgagataaactggaatatgatcccgatggagaacgtcgatcaagtagaggtactgaaaggggcctcttccgtattatatggctcttctgccttgaatggtttgattcacgtgaaaacgaaacgccccggattggatccggtaacacaggtgaacgtacaaggaggattgtatggaaagccgcgccaagacgggacgcctttatatggaggcttggatctctctcattcccgtaggatcaagaattttgatttgacagtgggggctaatacattcttggacgacgggtatcggcaggataattacaatcgccgtgtccgggtcggtgggaatcttacgtatcacgatccccgggtacaagggttgaactatggcgtgaacgtgaattatttgtataacgattataccggtttctttatctggcgttctccggaggagccctatattcaatctccgctggcgaatatgggacgccgtgagaatacattttatatagatcccttcttgaattatacgaattcggaaaaagggacgactcatcgtttcaaggggcgtttcttccatcggggaagccgtatcatcacgcatactacggataagtctctttttgacataacgaataatatgggttttgatatctcatccgtcccggagattatcaatatggcgcaaaactggcaaaccgagttattgccgaccttcttaccgtatttgccggaggtgatgaacgggaaggtgagcggattgatggctgaattgggcaagctgggaaatcattttttcccgacagctacctcggcggattatatggacttgatttcttgggtgatgggacgtactccgctacccgataagaataacgtaggggcttggttggtagatgccatgaaaccgatggagaaaaaagcgccggaggctacggatcatacctattcctataatctggattaccaattcagcaagaagttcgaacattcacaactcacggttggaggtacttatgagcgtattcatgcggattcgaaagtgaccgggcagcatagtagcgataatgtggctaccttcctgcaatatgatcataagtttatcgatcgtttgaacgtctcggtcggtgttcgtctggagtattaccgggtcgatgatttctaccgggaagcggagacgaagattttcggggcgaaggttccggtaaaacctgttttccgtggaggcttgaattatgaattgggtgagtatagttttatccgggcatctttcggacagggataccgttatccatccgttacggagaagtttatcctgaaggatatcggaggtgtgggagctttcccgaacgctgaattgaaagcggagcaaggttataatgccgaacttggtttcaagcaaggctataagttcggcaatttgaagggctttatcgatgtggccggcttttatacccgttacaaggatatgatcgagttccgtttcggcctgtttaataataagaccttcgattatatcgatgggctttccaagttgttcaatgcgttctctagcggcgacggcttaggaatcggcgctcagttcacgaacgtaggccgggcggagatttatggggtagacttgtctacctcgggtgtgtatgagtttaaccgtgatactcgtctggcatatactttggggtatgtttatacgaatccgatcgatatggacgtggattcacggaacgcggaggaggaagcgaatgatgacttaatggcgatgcgttcgaaatcgaatgacagcaagtatttaaaatatcgccagaaacattccgtaaagggggtatttgatctggaatggaaacagtttaatatcggaacgaatatgtcatggaaaagcaagacattggcggtcgattattttatggtcgatgagcgtacgaaagcggagcctaacctgatggattatatgcgctcgatgctattcggaaacttacatgattattgggcagagaacaataaaggatatttcgtcatggatatgcgtgtcgggatgaaagtgacgaagaatgtccatgtacaaggactggtgaacaacctcttaaacaagcgctatagcgcccgcccgatggatgtcggcgcaccccggactttcattctgcaagtaggagccaatttctaacaaattacctagttgtagagacggagcgtgctctgtctctacaacatgtgatagtttttcaattcgcttcgtaaacgaatcgcttgattgtccgtcaccttatccatcagtttccagaatctttcgctatggttcatctcgatcgtatggcaaagctcatgcaataatacataatccaccaaatgccaaggaagaagcattaatgattgcgagaggttaatgctcttcttcattgtacaacttccccaatgcgttttgctattattgattttcaccccggtcaacataaatccatgttgtctagccaatagcgtgatacgttccggcaacaaccgtttcgcctcgtggcggagcgccttctccagcatggatttcaataaggattgcacctcttcctcctcgaaacgagtctcattcggacaagcgatatgcagtactccatcctccaatctcatgtagaaattacttcgctcggtgcggaagatatgcaagcggaatgtcgtagcctgtaactccgatctttcgtcgagcaggggccgggccggatgcttctggagcgcttttaccagccgggccttgttctccatgataaaagcgatcatacgtttctcgtctcccccgggtggcatcgtggcggttatctttccttttgatatcttgagcgtgtatcgagtggcccggggagtggtacggagcgttatgactcccaaatccttgtcttgtatattcttttccattcctgccacaaaagtaatacattgagaaaaacaataatacgatggaattgattatcttcgcgatcgtaaaggttaaaaacataatcaatataataaattagcaatcatgagcaaaaaagcacttttaattatctgtgatggttggggaattggtgacaaaggtaaagacgacgtgatctttaacacgccgactccatattgggacgagttattgaaaacttatccagcctcacagttacaggcttctggcgagaacgttggtttgcctgacggacaaatgggtaactctgaggtgggccacttgaacatcggtgctggccgtatcgtttaccaagatttggtgaagatcaacatcgcttgccgcgagaatacgatcatggagaacccggagatcaaacgtgcttatagctacgcgaaagagaataataagcagatccacttcatgggcttggtttccgatggtggtgtacatagctctttggagcatcttttgaagttgacggatatcgccaaggaatacggaatcagcaaggcttatgtacattgcttcatggatggccgtgatacggacccgaagagtggtaaaggttttatcgagacgttggagaatcatctgaagactaccggcggtaagatcgcttctatcatcggacgttattacgctatggaccgcgacaaacgttgggaacgtgtgaaagaggcttacgacttattggtcgaaggtaagggtaagcaagccgagtgcatggtaaaagcgatggaagagtcgtacgccgagggtgtaacggacgagttcatcaagccgatcgttcacgttgagaacggaaagccggttgctgttatcgaggaaggcgatgtcgtgatcttcttcaactatcgtaacgaccgtgcgaaagagcttacggttgtattgactcagcaagatatgccggaggccggtatgcatacgatccctggcttgcaatatttctgtatgactccgtatgacgctagcttcaagggtgttcatatcttgttcgacaaagagaacgtaaataatacgctgggtgagttcttggcaaacgtaggtaagactcagttgcatatcgccgagacagagaaatacgctcacgtgactttcttcttcaacggtggccgtgagactccgttcgatagcgaggagcgtatcttggtcccttctcctaaagtggctacttacgacttgaaaccggaaatgagcgctttcgaggtgaaagataaattggtggacgctatcaatacgaagaaattcgatttcatcgtagtgaactatgccaacggtgatatggtaggccatacgggtatctacaaagcgatcgagaaagcggtcgtaacgatcgacgcttgcttgcacgatacggttgaggccgctaaagccaacgactatgaggtaatcatcatcgctgaccatggtaacgcggatcacgccttgaacgaggatggcactccgaatacggctcactccttgaaccctgttccattcgtttatgtgacagccaacaaggacgctaaagtagaggatggtatcttggccgatgtggctccttcaatccttcacatcttgggcttgaaacagccgaaggagatgactggcaagtcattgattaaataagagctaggcgcatcttatgatccagatagatgacactttagtaagtcttgacgttatcgagcgttattttttatgtgatctttccaaatgtaagggggagtgctgcgtggaaggagattccggcgctccattagaggattcggagttggcgaagctccagaaagtattgcccattatctgggatgatttatccccgaaagctcaagaggtcattaataagcaaggcgtagcttatatcgatgaggaaggcgatacggttacctctatcgtgaacggcaaagattgtgtctttacctgttacgacgccgatggtacttgtaaatgcgctattgagaaagcataccgggaaggtaagacggatttctataagcctgtttcttgccatctttacccgatacgtgtcactcagtatcgggatttcaaggccgtgaactatcatcgctggagcgtttgtaaggcagcggagatcttaggaaagaaagagcaattgccggtttataagttcctcaaggagcccttgatccgtaagttcggccaggcttggtataaggccttggaagagtgtgcggaggaatggaagaagcagcgtgaggagtagcttttagatcgtttataaatattaaaaatcccttcagtctctccctttgataactatacgttaaaaacggatggaggctgaagggattttgttttatagtcgctctatttcctcaagggaaaggccggtgcatttttggatgataagaggggttattccctcggctttcatattacgtgccgtagattctttccctttttgcagtccttcttgcaatccttcttgtaatcctttttgcaatcctttttccatgccttcttccatcccttttttcatgcctttctcaacggcgaagtccaaggtgttataataatcattatacatcttccactccgcctcgtactgcgctcgttgtttgggggtgaggttcgccatggatccgatgcgttccaaccgctcgaatatggccttgcgtgccttgaaaggcattctgtctaatgtatccatatgctttagtacataaatccaacgttcaaaatctgtctcgcattcttcctcctctttgttgaatcgaggaagctcaatatagatctggcggaacttggggttgaatacctgtccgttctcccgatccgccagcacgatgtcccttcggaactttccttcgttcctgttattgtttggcctgttctcctcgtctagcgtgaagttcaagaaaaaaacaccgtacacggccgccagctcatagtcccatgttccctttatcccctgttccaccaccgagtgcgagaggtagtataaggccctgtccttgaagtggggctgttccctgttctgcatctcgattatgatccgttcgcccttgtcggtctcgcaatggatatcgaagatgaccttccttccttgctctgtctcgggcaatcgctcattgttcatgatcctcaggtccatgatagtatactccccttcgaggaggtcattcaggaactcgattaaaatgtccttgtccatttccctgccgaatatgtgcttgaagccgaaatcggtgaaggggttgataaattttcccatagtgtttataggttttagtgattaataggatatagatggctcttttccatctttggcgataaagatacgatttttattatatggggcattcatttaggctttaaaaaaacacgtacgtctttttttcggaaatatcttgtgtagtttgagtgaagacgagatatagtgaacgcataaaggatacagccttaaagctaaaggtgggttaatgaggctttccgcgtcaaatgtaagccatagcttatttgaaaatacgggaaacatgtgcctgtacaggccctgataaccaagaaacgggccctctcattggctgttgaagtgaataactaatcacttggaaagcctttttatatcggaaccaacaaggtcttctcagtggctttgggatgcggttcagttatcctgcggggcttttccatgtcgattattctgttatagccctcgcagatggatggtaagcgaagcggcgataatcatgacagtttgcgcgaaacaaggctgtttgtttgacatacctcttctttggtgaagtctaactagagagaagaaataggtgaaaagggcctttttgtctcttatttataggtaaaaggtcgcttttccggtgagaaaggtggtgtttgcctacgcaaatatatgcgttagccaacgcaactgtatgttttagccgacgtaaccgtatgtattaggtgatacatacggtagtaattcccatcgcatacgatagaaatggccttcacatacggatgaattacaggttttagccttaagaatatgaattaggatgaataattttcgccagaacgaaagggcatattccgttatcttgttatggaataactacttgcgaatattttttctcgttttacggaactatatgtataatctcccggaaaattcgattctcaagggctttaatttacaaagtgtcacaatgacaatccgtaaattccggatgactcgtttaatataatattaatgtacgcctgtacattaattaatgctatactataaaagttgatgaataatagattgaaatgatatctggagtatggaaacgactagtttaaacgaacgattcttttagtcatttgcaaaggtacgcgtttcttcgatacttgcaacccttccgggctatttttttacagcttattctctttcttatcaataggataggttatcctttacgaaacaagcgattccttcaacaaacctttctatttaccccttataaaacgcaagattaaaaccttcgtttaaactagtcgtttttgaatgacaaagcaatcgatacgataacgtaatgagctgattatcttaataaacactagtattaatattaattttagaattatgaacaaaaagttttctactcttttggctggtgctgcgcttctgggtgcggtgacggctaatggtgctgttaagctgaatcaaggagcgaataacggtctttatcagcttaaggcaggttctgctttcttgagtattaccgaaaattccacgactcacgaagatgaaatcaaaatggtttctcactcttccgcaaatttaggaggtacaatgtggtgtgtaacggttgatgccgagaatcaaggacagaatcctaagtatgatttcacgaacaagatcggaaagtttttaggtcttgagatcagcacgatcaaaggtaaggcggcggctccgttagctgctgtacctgctgttgtcggtggtgatctttccggttggaaattctctcctgtatttaagaatggtgtggagaaatccgttctctattcttatttcacgaatgactctgtaatcggtttgaaggtgaatactagtggcgatgtagaaatggttaaaactatagctactacagctggtattactgccgctggtttcactgaatttgagttggtagaggccgcttcgatcgttgtctcaggtgctgatgaattgaatacgatctttggtacccaagataagaaagctggtatcacattgaagtttactccggatgtattaggagatggagcggtaaactactttaccgagaagaagttcacggttgaagcttctggaactgctaattatttccatgtattgagagccgactcttcttacttgtacgtagatactgcttatacgaatgctgtgggtggagctaagttcttggcttataactggagcaacttaaaggatacttataagactggtactaagaatcatgctactccgaaagattctatcaatgctacagatttatcagaccaatataaatttatgtttacatattggccttcaaatgacagcttggagattcaggttaaacaatctttgttaaaaacaagtgagacgtattggaaagatgttactgctactacagctatgcaaaatcagcatatctctttgcaagagttgctgaaagacaaggttcgtatcttgacggtagatgcggctcaaaatactaagattgagttaggtttcgcaggttgcaaagttttgcctactacaaagacaactgttgatgatggtgtttatgtaatcagaaatgctaagactggtaagtactatgctgctccgctttataatgaatctgcatctagtaaatacgagtgggtgactttggatattcaagatgctgctcatatgcctgcttatcaatgggttgtgttgaagaagaacgtaacagataagaataaggtttctgctgtagatttgtataaccgtgagtataatgacggtacggctgctgatgcgactctccaattgaataaaaatgcgggggctacttatatgtatgctgctagttttggtgactctttggaatttatcccagtcgctaaagaaatctatactgataagtatgtgggttataagcatctgactaatgatgagttgatcacgaacaaatatactttcaactactggcatccgtacgcatctgataaatttatcggtgttaaggattctacgatgaatgtgttagagggtaagaaagcgttcactcttaagtcttcttacaaagaacatgcttatggctataatccttctgaggaggtttccggtaatgcggacaagaagatcacgggtcgtatccctggcttggtgagaccggtaagaacgatgtatatcattactaatggtgagactactttccgtaatcataacgtagcggtagagtctaagtataaattgagtaagtattatcctaatactacgaatgactctgtttacttcaaggagaacaaccatattgagggtaaccattactatgctatccttgaggctacttccacaggtgctatcagcactcataaagcaggtgtttccgattatgatgcttccgctactttgaaagctcaggtaatgggtgagactcgtacttccgcattcgctatcgctccggacgagactccgttgtatcgtcaattcaataatgaacttcttggtgagaacgttgataattcagctgatagcttgatgttcaaggaaactatccgtggtgaatatttgatggatgagcataatggtgccttgttgaacaaggatgttgattacgctggtatctggagtgagggtaaggctgatggtaagttggctttccgtattgacacagcatggttaactcgtggcgcaggtaaggttaaacctcaatacttggtatccgcttatcgtgagttgatcgagggtgagaagatcattccttgtactgagacaggcaagcatatcactgctgatggtcaagttacagaagatccatatcaatgtgtacatgctgttcatgtgaagactccagcattcatctatggtaagtatttggttaactactcagactctgctgccgctgttgctgctcgcaaggaagctcttaacccgtacttgttcaatacgaaagcagtttcaaacagtagctatactcgtgtaggtttcgttcctgccgttcaatatggtgataccttgatcgttttgacaggtaagtacaaagctatgactgctgatcaattgaagaatgagggaatcgagtctattatggctgtttataagaaagattatccgaaattcatcaacgtattgtctggagacaagcataagaacgtaacttggtcattccgttatgtaaatccggataaggctgctttagcttatgtagatggtaaagagggtgagaacaactcattcttgatcgagtctaacgtatatgcaacaggaacagatggtgataatcaatatcagactatcaagggtgatttggcaaaagctatcgctcctaatgaagctgccgcatggttgaagatgcacaatggctgcttggtattgacagatgctagctctacatttggtgccgctaagactggtggtgatggagcattggtattcaacgcatattctaagactgaagatgatgatatggtaacatctaacgataacatcaacaatgttgaaggagtatctgtaatcgctggtaacggtacagtaactgttcaaggtgctgctggcaagtctgtagttatcactaacatcttaggtaaggttgtcgctgagacagttcttacttctgacaacgctacaatcgctgtaccggctggtatcgtagccgtagctgttgatggtgaagaggctgttaaggtagtcgtaaaataagactaaccgatggactaaacgaatagaggcggggagacccgcctttatgtaatatataattaaataactatgccgcaataaagaagtatcccgtgacgggtgaacacgtggcatattaatactaaagtaattaaaagttcttccgcaggtatcctcgtgagaagagagagcggatcaaaaaacaagccccgtgggatttatcctatggggcttttatttatcgtatcgccaccttgcgtaccgtatcgccaatgcggatgatataatatccctttgcgatatctacgacatattcggcggtggactgcttgacttcgatttctttcaccttgatgcctacgacactgtagatttccaagatactcccgacaggagcgttctctaccttgatgcgattctcgtaggccgtgatttcgataggagagggatcttcttgcctagaagcaaatgtcttgactcccgatttattagcttgcgcataaaccggataacttgcggagaatgcaagtgccaaagcgatgatatgtataagcttcatttacttgtccctaaattcgtacaaatgtagaaagttttccgcatattagaaagtaattagctttatttcgtaaaacggatgtatgattatacgctaagcctcataccttcctctcctaagatcgtgccgggaaatatcttgtctgcttctttctttaacggtgccatatcctcgtaacgagccgagtaatgaccgataaccaatcgcttcacttgggctttataagcaatctcggccgcttggcgggcggtagagtggaaggtctctttcgcacgtgcggcgtcacattcagcgaaagtcgcctcgtggtataataaatccaccccttcaatgatggggattatagatgggtgaaaagctgtatccgagcaataagcataccgtttgggagcgacggcagggcgggttaagcgggcattcgggattacctctccttccggggtgacgaaatcagcgccccttttgatctcttgcatcatacggacgggaacttgatagaaatctgtcatctcccggatgatatgcgcttctttggctttctcggcgaataaatagccacaacagggtatacggtgctttaacggaatggaataaacgcttaaggagcgatcttccataaccaacgaatgagttgtcgggtcgattaagttaaaacggatctcataaggcaaccctttacaaaagatatcaagtatcggacgcatatagctctcgatctctttcggcccatgaataacaagttctccattacgtcccaacatacctaatgtagagatcaatcccggtagcccgaagcaatgatctccgtgtaggtgggagatgaagatatgatttaaacgactgaattttatacgcatacgacgcatttgcacttgcgtgccttctccgcagtcgatcatgtatagtttatctcgtaaatctactatttgagaggtcgccagatggcgtgtcgtgggcaatgcggaaccgcatcccaatatgtttatatcaaaatcagccatttgttgtctatgggaataattgagtgcaaagataatacaaaagcatttctgttctgtgaaaaataacaaaaaaacaaagtgtaatgtatgcaggatgaggtggattccatatatttgtttgctgtccttcgggaaagcgaatatacagtcggtaaatagacttaagatatttttttctaagccttaactaactttttctttttgtttaaaacggttaaatgtagaaacggccaagcgtgagcttcgccgtttcctttttttattgttattttgaaatctaaatacctatatctaataaattatgtcatttaacaatctacgattatgaacaagaattttatctctgttttcttcctgatgctcgctatgggcgtatctgttatggcccagagttatgaggaagatttggctttttttaaggaacgagtaaagactttaggctcggatgagttcggagggcgtaagcctttgaccgagtatgagacgaaaacaatccattacatcgctgatgaatttaagaaactaggtcttcaacctgctaatggcgatagttatttccagccggtgaaggaaatatctacttttacccgtccggtaaaggataagatcacggtgaaatgcgcgaaagggtctatggatttgaagttctcggatgatattgtcgtttggacgaaccggggaactgagcaggtagttatccctactacggactatgtgttctgtgggtttggcattaatgcgccggaatatggatggaacgattatgcgaatgtagacgtgaaggggaaaatcgttatcgctatggtgaatgatcccggtttttatgatacgtctttgttccgtggaaagaacatgacttattatggccgttggacttataagttcgaggaggcgcaacgccaaggtgccgcaggtttattggttcttcataacgaggcggccgcttcgtatggttggaaggtctgtcaggcttctcacgtgcagacaaatatcgctctttgctcggagacaatgaatgcggaagctttgggcatgaagggatggctctcggaggaggcttgcaagaaaatgttcgcccttagcggattgaattttgatgagacgattgccgcggcgaagaaaccgggtttcaagagttttacgatgaaggcgaaaagtaaggttatattaaatgtaaagatgactgtaggcgagtctcataacgtggcggctgttttaccgggcacggacctgaaagacgaatacttggtttttaccgctcactgggatcattttgggatcggcacgccgatagatggggacagtatctataatggcgctagcgataatgcttcgggcgtggcaaccttaatgttattagctaagaaatatcaatcattgcctgttcattcccgtcgttccatcgtattcgtggcggtgacttccgaggaatgtggcttattaggttctcagtactattgtgagcatcctttgttccctttatctaaaacggctattaacttgaactttgacggcacggctccgcgtgagcgtacccatgatatttctctccgggctgcgggtaagacggatacggatgccttggtgatcgctatggcctcggcacaaggacggaccgtgaaggttattaccgaagatcctgcgggtggttatttccgttccgatcattttaatttcgtgaaaaaaggcgtacctacgattttagttggtggcggtaaggattacgtggataaagcacgccatgaggctaaaccgaaagtttaccggtatcaccaaccgaatgatgagtatgatgaatcttggtgggattttgatggggctatggaagatatgaacttaatgtttagtatcggtttagttatcgccaacaatgatgagatgcctaagtggacaaaagaggcggacttccaaaggcaatagattaatgtgccaatgtagcaatatgccaatatgctaatgtgtcaattaagatactatcacttgtattctcacttgacattgacatattggcacattggcatattatttaatttgcacattatttaataggtatgacctccttcttgcatttccttactattgatcttatgtagatcaagcgctctccaagcatagaaaatgtaggctaatacgaatggaacgagaatagatacatagctcattactttcaacgtgaatgggcttgagcaactattctggatcgtcaatgaactttgtagatccgccaaagatgggtagtaagccgtattattccatcctgcgcaaagtaataaagctaatacggtcaagacagtccctgctcccgcaaaccagatgccttttctccaagtcttcgagaatatcgttttccctatgccgaatagcacgccaaccacgccaatcaataatacggctaacacgattggcatctcgatcaggttcataaaatacttatacggttgcataaatacttctccggtatccggatttacggcaaaaccgtccaccaacaataaacggatcaagaatgtcaagaaaaagacgaggaacaagattgtctccggtatcaattgtttccggcttttagcgacaatctccggatcatcgatattgttgataaaatagagtagggccagagctcgtgccaagaagaaaactgccagtcctaggcacaaattccaaaataccaaagccgcctctaatccatgccaaggattggcccacgtggaaatgacgggcatggctacatcagtcaactgttctttgttaacaataaattcagcgccgttaaagaaggtcgctacagcggttccgagtaagatcggacctgctataccattgatcataagaaatacttgatacgtctttttcccgagtaggttgccttttttcgcttgatactcgtaagatacagcttgtatcacgaagcaaagcaagatcagcatccatacccaataggctccgccgaagcttgtggaataaaataaagggaaagaggcgaagaaagcacctccgaaagtgaccaacgtagtgaaagtaaactcccacttacgcccggtcgagttcaataacattttttgctgtatctccgtcttgccgatagtgaagagtagagattggcctccttgtacaaaaagaaggaatactaatagcgctccgagtagagataccagaaaccaccagtaatgttgtaacaatatatatgtactatccataggactttctatttaagaattgatatttgaaaattgaaaattagtgggcggcagcttccggccctttcttgatggccttaaccatgattccaatctctgcgatcagcaggatcgtaaataagataaggaacaggtagaaagtggtctgtaccgaggatgggtttaacttggatatcgaagcgctggtcggcaagatatcctgtatagcccaaggttgacgtcctacctccgctacgatccaaccggcttgtcccgctatatatcctaaaggtatagaccataggcccacgtattgcaaccaacgtgtattagcgattttcccttttttatcccatatcaacgtaataatgaatagtaagatgaagaaacaaccaaggatcaccatcacacggaaagaatagaatgtcaatcctacatgcgggattaactctgccggatccttaatataaccatatccgaaataggggaaattctcttccaaggttaccctgtattgtgcggctgctgcggtatctttatctttaaccgctttgcgataatcagctaacgctttgatggcggttttacctttctctattttttctttggcggagagcgctaccgttcctttattggtcgtataacctccctctattaagtttacgattcccggaacgtatgcgttcatgtcacgttctgctaagaaggagaggagtttggggaacttaatgtcaaaaataaatgcgttctggttatccagataactcgtctttgccggatttaagatgccgatacctacgagtcctactccgttgccaccctcataaagaccttccatggcggctagtttcatcggctgcttttgagcgacttggtaagcggagccatcacccgtccagataataaggatggaggctaccaacccgaatatagcgctgaccttgatacttgacaaagcgaattcggtattccgtttctttaataaataccagcagctgattcctagtacgaacaaggcgcctacgatccaaccggacaataccgtatggaaaaacttattaatggcgacaggcgataaggctacggcccagaaatcgaacatctcgttacggaccgtatccggattgaaatgcataccgaccggatattgcatccatgcgttagcgatcaagatccagagagcggaaagagtagcgccgataatcgtcagccaagtggaggcgagatgaaagcgtttgctaaccttgtcccaaccaaaaaacataacagcgataaaggtagcttccataaagaaggcgagaattccctcgatagccaaaggtgccccgaagatatccccgacaaaccaactatagttagaccagttggttccgaactcgaactcgaggatcaatcccgtagcgacaccgatagcgaaattgataccgaataatttcatccaaaattgggcggtctttttccatgcctcattacctgtccgataataaatcgtctccataatagcttggataacgccaagtcctagtgttagtggcacgaagagccaatgatacatggcagtaagggcaaattgagccctcgaccaatcgatcaatgaagtgtcaatgttttcaatcatatttattaatgttttaaggatttattgcccgttgtatgagttcgttcgatacgtggttctccttctcactatcgctatcgaattgcccgagataattaggaaagaagaataatctcaggataaaaaacatgataaacaatttgactagaatgattagccaaagagtcttgcccagcttcatctcccggaatccttccagataaaagcgatatattcgtatgaatgcagattcttttttcatatagttgttctcatttaagataacagttgttaatatgaatatgttttcatgtttttacaaatatatccaaactgcgttaataaaatacccccaatcctatagataatatttatgaaattataaataagatctatcctgtctgttaaaaaaaactattttaaataagaaagcggtcttttgatcttgtcaataatacagcattggctatatttgcgacaatttgttgcctgtaaaggtgtaaagacacatgaaatatcattgttaagtgctaatctataaaaaattattactatgtctaacatttctagaagatcttttcttcaaaaaggtacggctgccgcagcagctttgactattgttccgagtgcggtcctaggtaaaacccatggtcatatcgctccaactgataaattgaatattgccggtgttggtatcggaggtatgggtaacgctaacttaaagaacatggagactaccgagaatatcgtagctctttgtgacatcgactggaagtactcaaaacctgtattcgaccgtcatcctcaagctaaaaaatactgggactatcgtaagatgtatgatgagatgggtaaatctattgacgctgtgttggtagctaccgctgaccatactcatgcgatgatcacagctgacgctatgacgcttggcaaacacgtatacactcagaaaccgttgactcactctgtttatgagtcccgtttgcttacgaacttggctaagaagtatgacgtagctactcagatgggtaaccaaggttcttcattggctgaaggtgtagatttgatctgtgaatggatttggaatggtgagatcggtgaggttactaaagtagaatgcgctaccaaccgtcctatctggccgcaaggtttgaacgctcctgagaaagttgataagattccttctacattgaattgggatttgtttacgggtcctgctaaattgagaccgtttaataagacatatcatccttggaactggcgcggatggtgggattatggtacaggtgcgttgggtgatatggcttgccacatcttacatccggtattcaaaggcttgaatttaggctatccgacaagagttcaaggttcttctacattgttattacaagactgtgctcctaacgctcagcatgttaagttggtattcccggctcgtgataatatgccaaaggtagctatgccggaggttgaagttcactggtatgatggtggtatgatgccggatcgtccagaaggattccctcaaggtaaggaattgatgggtgaaggtggtggattgtgtatcttccatggtacgaaagatacattgatctgcggttgctacggtgttaacccatggttgttatctggtcgtaaaccgaacgttcctcaaacattgcgccgcgtgaaagacgctatgaagggtggtcacgaacaagactggattcgtgcttgtaaggaaagcgcaggcagccgtgttcagacgaagtctaacttcttggaggctggtccgttcaatgaaatggttgtaatgggtgtattggctgttcgtttgcaaagattgaataaagaattgttgtgggatggccctaacatgagatttacgaatatcgatccgaatgagacaatcaagatcatcaagaaagatacattcgaggttatcgatggtgacccgaaattcaagacagagtggacggatccaattaatgctcaagaatttgccgcaggcttgatcaagcacaactaccgtgaaggctggaagttggtagatatgccgagataatagttttaactcaataaataaaatgaaaaagtcagtattattagcaagtgccgctatcatgatgtgttatttcacttcttgtggtggtggaaagaaaacagaagaagctcctgcagctgctgagactacaacagaagccgcagctcctgagtacaagctcatgacagatcttcctactgtagatatcacgactttcccgaaagataaagagggtagatatgtgatcttcgatggtaagacattcaatggctggagaggttatgaccgtgctgacgttccgggtgcttggacaatcgaggacggagcgatcaaaatcaatggctctggtgctggtgaggctggtgcttccaacggtggggacttgatcttcgctcataagttgggtaacttcgagcttgagttcgaatggaaagtaggtaaaggctctaactctggtgtattcatcatgattcaagaggtagagggacaaccttcttacatctctgctcctgagtaccaagtattggataacgagaaccaccccgacgctaagttaggtaaggatggcaaccgtaaatcttcttctttgtatgacatgattcctgctaaaccgcagaacgcaaaaccgttcggtgagtggaacaagggtaagatcatgtgctataagggtacagttgttcactatttgaatagcgatgaacctgttgttgagtatcacttgtggactccgcaatggaaagaaatgttggataatagcaaatttagcaaagacaaatggccgttggcttatgagttgttgttgaattgcggtggcgctaacaaagaaggtttcatcggatttcaagaccacggggatgatgtttggttccgtaacattactgttaaagttttggattaatcgtatcaagcacattttagcataaataacgcccgaggcctaaatctatgattttagcttcgggtgttgtgtttttaataatcgactttttctaaaccaattttttaggaccaagaaatgaaaatagaacaaggttacacgaaagcgcagatgacttggctgatgatgctgcgtctttttataggttggcactttatgtatgaaggcctagtaaaaatcatgaacccaaaatggacatctctaccctatctactcgattcaaagggtcccgctgcttcattttttatcaaattgactcaagacgacagtttgatgacaaccatcaacttcttgaatgagtgggctctgttattgatcggcctaggcttgactttaggctgtttgtatcgtttatcttctgttggaggtatgattcttctcgctatgtacacgttatcccacccctctttcgtgggagcgagctatatgatgccgtttgaaggctcttatttatggattgacaagaaccttgtggagttcgccgctttaggcttgatgtgcgtattccctacatcacaaatcataggattcgatcgtgtgttaggacgtgtgtgtccgatattgcataaacttaaatttatttgatacccatggcaacagaagatgcaaagaatactccttctcaggagcaaatgcccgataaaggacgtcgggacacattgaagacattggctacagtgcctatcttaggtgctttggcatatggcgtttaccaaaaaaggaaagacgctttaagaggccgtaacatatcagatgtatttcaggtaagtaacaggcaggcctcctatttagagccgcaaggcgatggtaagaagatccgtatcggtttggtaggcttcggtattcgtggaaagcaattgatgcgtgccgcaggtttcgctgagccttcttggatcgataagatgaaagaggctaataagttgaataagaaagacacgcgttatcagcaatatatggagcaagatgatctgaatattgagataaccgcggtttgtgatatatttgatgtatatggtgaggccgctgtattgaccggttccaatatccatcgtgagggtagcggcggtaagttcgggcctgctccgaaacgttaccggacttatcaagagctggtaacggctccggatgtggatgccgttattatcgctggtccggaccactggcatagcacgatcgctatggctgcggcacgtgccggaaagcatgtatattgcgagaaaccgttatcatggacggttcctgagacgtatatggttcgccaagtgatcaaagagactggcgttgtatttcagttaggtcaccaaggacgtcagaccgattgctatcagaaggccgaggagattatcggtaacggattattaggccctgttaacttgatcgaggtttgtacgaaccgtaactctccaaatggtgcttgggtatatgatattatcgaaggctctaatccgaatacgatcgattggaaacagtttgaaggtgatcctgagcgtattaaggagtatatggattatatgacatccaataagcttgaaagatatatcggtccggacgagcgtagcaagtttagtctggaacgtttcttccgctggcgttgctggtgggattatagtacaggtctttccggtgacttgttgacacatgagtacgacgctgtcaaccagatcatgcatgtaggtatacctcattccgctacttcatccggtggtgtttatttcttcaaggacggacgtacggtacctgatgtattgcagactactttcgagtggccggatcgtgacttgacgatgttgtatagcgctacattggcaagtagccgtaaccgtggcaaggtgttcatggggcatgatgcttctatggaggtttccaatatcttggctattacggttgaccaagattccactcgttatgcggataagatcaaggaaggtattattcctacagataccccgttctatacctatgtaccgggacaaaatagctcggattccgttacatctcctacggagttgtatttcgctaaacgtggtttgctgtatacgtatgtaaatggtaaacgttatgatacgactcacttgcatatccgtgagtggctggaatgtatccgtcaaggcaagactcctagctgtaatatcgacgctgctttccaagaagctatgactgcccacatgggtactcgcgcttatctggaaggacgtacgatgtactgggataaggacaaagaagagatcgtaagaggtgaacttgcgtaagtatctaaaaagacgataaataactttcccaagaagcgaacttcataaatggatggagttcgcttcttttatttgtgcatgtataaaatttcttctcttttttgtaaccgatttgtgattactcatgtcttattgataaaagcgaataatttattaaacctttaaagaataaaagatatgaacgagttgtggattcctattttaggtgttatttgtgcggtaggtatgccggtattgttaggtattatcgctagttacatgaccattaaaagtaagcatgaggaaaagatggcgatgatcgagaaaggaattgtgttggaagaggctatgcgccccgagagaaggcctaatcgttataataccctgcgtaacggtatttttatgatcggtttgtcattgggtgtgattgtcggtatgatgctcgactctgctttcacttacgatagcgattggttctttttgttagttccggctattacgattatgttcggtggagtagcttttataatttatttctttctttcccgttctttaatggagaaggagagattggaggacgagaagaaaatgcgtctggaagaataaacgataccggatggatgagcgaaagtggatagaacgtattttggcaggggacacgcaaagtttctcctgccttgtcgcgaagtatgagaagatggcttataccatcgcttttcgtatcttggaaaatcgcgaggaggcagaagaggccgtacaggatgcgttcgtgaagatgtatcgtgctctttccgattttcatttcgatagtaagttctcaacatggttttataggatcgtgtatcgtacggcgttgacggccttgagacaacagcgtatgttcgtgagttatgaggaggcaggccctgtagacctttcgaatgacgaagttgaatcggctacggctttattagagcgtgaggaccggaaagagatgatcgcacgtacgctgaaaaagcttccggctgatgaggccttgttgcttactctttattatttggaggaatgctcggtggaagagatctgtcagatcactgaattgagcgcttctaatgtgaaagtaaaactattccgtgggcggaaacggttttatgaagtgttgcaagataaaatgaaattagagacagctgatttgttatgaatatgaatgagaaagatattgatcatttgacacgtaagttgatgcgagggacggcggaacaaccttcggcctcattaaactcccgtattatggcattgattatacaagagaagaagcgggtatataagtactatatcaagaaacgatttacacctgtaggcatttttagcatatttgtcgcttatatgcttgtgttagtaggcatcttgtatttggttaagctttctccgggcggggcggaaacggttttaggctctttgcgagcctatttcccgattgttttaacgattgcttccgggatctcttgtttcttcctgtttacacaactcgataactggttgaagagagaagagatacgccggcaaaacacctcaaaataaaaatatccggttgtagagacggggcacgccccgtctctacaactgattaattggccttgacttttagatttccgtaacgatttccttcgaagtgaatcgtcggttgctttccaccattaatctcataggtgtaattcttgtcacgatcctcatcgtcaaaatgcttgcgggtgatattgaaaccgttcacgtcgcagcttgaatacttcatgttctccgctactatccggaaagaagtttttgcgggaagcgctacctctaaattcccataatgggattctacgttcaccttcgagaaagagggagacaagttccgtatctttaagttactatagctaaggctacttacattcaatgcatccttaagggtcccgattttagcgtcgctgtacttaatctccatgtctagtctgcttacgctttcaatggtgagattaccatatttaatctccatgcgtaaagattgtatatcctgtatatccagattggaatatttgctgtctatcgttaaatctttagcgttgcgaatcttggcggttcctacgtagcccagatccagttgggcgtcctgcagatttcctacctcgatgttaccatatttggcctctatcattgcgttggctgtgaaattacccgcattcaggttgccgtattttacatggatatccatgttgccgttattatcgcttggcaagttgatgtttccgtatttctggttcaagtctgcggcgagcttaggaggcatctggatataataattgatcgtcatggactcattattcgaattgctattcatctccttctttatcgtagtgaccgctgagacaataccacctatcttcttggtctcgatttggatacggtccaagttctcttgagcacgttcctcgctgcgagccttacattctacctcaacccgtatagctaccgtattctgattccagtgggtaacggtgatgtttccataacggttttctacttggagacgatcaccggcgcttacgctgtaggattgggatatctcttttttcttgatcttctcttgtggcctagctattgccgatagattgcatagcagcaatacgaaagtcagcaatacggcgggactcaattttacgtgtgtcgtgttcatgattgatatgtattaattgttattactatttctggttatccgtgacttgttccatttgcttaagcatcagcgtgaggccctccaagctattgctgtaatgttgggtcatggcgaagagaccgtcgttggaacaaggcaaggtagggagtatcgtttcctcgaacatataattatccgtgaggatccgtttgctctcttgcaataactcctccgctcccggtgtccggtcctgtttatacaacttcttcatttgcgccaatacgtcgttcatttgcatattgtaatataggcgtagttcctcgatctcctcttgggtctcgcaggtctgggccgtggtcttttgcgcgggttccggcagaccggtcccttccggcaagcggaataagagcaacaaagcgatagaggcagctatggcaaaggccgataggctgtatagggccgcacggtttttccgtggcttcggcagcttttgctcgaaacgttcgaaatgaccttcgggaagcatctcatcttccttgaatgcgtcacggttcgcgtctatgaaattctttagtttatccatgtttaattggctgctataatgtctaacaatttccgcttggcgcgtaggtactggctacggacgcttggcggttgaattttcaggatagaggcgatctcttccatatcatatccctcaaagaggtaaagcgagaggattatgcggtagcctgccggcaacttcttggtagcttcctttatctgtgccacggaatattggatttcttcctcgtccggtccgtccgtttccggttcggccagattgtcggaaagctcctcttggtccggtgcttggcggcgtacataatcgatggccgtatggatggcgatgcgatgcatccatgcctcaaagcattgcccgtcatgatattggtccaagcgtgtgaagatcttgaggaacgagtcctgcatggcttcttccgcctcggatgagttgcctacgatacgcaagcaggctatatacaatcgctgtgcgtattgtttgtacaacttcagttgcgagctccggtctccccggcggcaaccctcgatcagatgttcggttactttgtccatttgtttatataaacgagagtgatgccttgaccgttgcatcttgtagcgtaaaaatacaaaaaaagaaaggcatcatctcgacgcctctcctcctgaactaaatgataaaaataaaagttatgtgggaaggtttatttcatgtccgttatattggagatactatcgttcgtatagccttgcgaagtatcctccattttggtcttatccgaattatattttaatttataagcctgtttcccttcggaagtccaatagtttacgacaagatcgaccgtctctcctttggtatccggcaaggaagacaaattgaacgccacacgtccggccccgatcgtatattggggatcatcgtaagcgttatgcctaaactccagcgtataaggatcattctcggcatccggttggatcaggttgataaagtgggcggtcttgcctccccagagtgtctcgaaatagatattcaaatatccgtctccgatccacatattattgttataaatacttaccgggtccgtaccatagatagaatcattagccgctccctcgttcttagcgatggatttcgtaaggatgttatggatcgcgttcaccttgatatagtgggagaaacctcctaggttactttgggtggaatccgccaatatcgtgaagttaaccaaggcacgttggttaggcttcggctgatagttcggatagttcgtggcggcgggccatagcttatccccgtcatccagccgtaagtaatatacgttattgccttccggtactacggtagcgaccgctatccagatatcacctaaagaatacgagttatcgtcatctaagcaagagggtagggtgagggatactaaagcgatcccgataaccaataaaaaagctctcaacgtcttcattccttttgtttcttaaaaagttcacatttcatcgttctatgaggaaagatgtaagttcggggtgaaatgctgcaaaagacgttaataaaagatgttaagaaccaagggattcaacgattagccgtgccgtacgctttgaagccccgggcattcctagcgtatggataatcttgtcgtatccgtctagcattcgttttcgataggctggatcttgtaggatgcgtcctagctcgtcttgtatttgcgattcggagaagcgggctccgaatagttcttgtacgatctcccgtcccccgatcaggttcacgagggatatgtatttcgtatggaagaaatgcttgaaaataaagctggccaactgtccggctacaacgtagtagcaaacgacttgcggaacccggaacagggcggtttccaaggttgccgtgccggaggttaccaaggcggcggcactatgttgtagcaagggataggttttaccgaacacgatcttggcaggataagagcctatgtattcttgatagtaggcaggatcgatgcctggtgctccggctattaccggctggtagtcgggatatgcggaggctactttcagcatggtcggtaaattatccttgatctcttgtttgcggctaccggatagcaaggcgaggataggcttgttggccaatccttcctctttgataaatgtatctttggggatcgcttgatgctccttgtaataggctacggagtctacagaaggatttcctacgtaatctaccgaataattaagcttccggaaaaactcggtctcgaacggcaggatgcagaacatacgatctacataacgccggaagtccctgatgcggtattgtttccaggcccatatcttgggggatatatagtaatataccgggagacccaattgggttttcacatatttggcgatcttcaggttgaatcccggatagtcaattaaaatgacgacatctggctgatagcggcggatatcctcttggcacgtcttcatgttatttaagatggtgcgcaagttcagcaataccgggataaagcccatgaacgccatttcccggtaatgtttgacaagggttcctccgacggctctcatcagatcgccgcccagaaagcggaactcggccttcgggtcattctctttcagggctgccatcaaattcgaggcgtgcaggtctccggaggcttctccggctatcaggtaatacttcatgaattgaaaattgagaattgaaaattaaaggatccagttgtttaaggtggccatgaagtcgtagtccgtaacgtcgatcttgcaggggactagggaggcgtatccgctgtccagcgcaagcatatcattgtccgggtggatgggtttggcgctttcgaaagctcctgtcaaccagaatacgggctctccgctggcgttctcggaacgcttgaattcacgtacccaacgaccatccgcttggcgacaaactttcaaccctttcacttgcggtagcttcggcacgttgaggtttaagtaggttccgtgcggtaagccttcttttaatacccggcgtgccagcatacgtccaagacggcagcattcggagaagtcggcatcggccgcatggtccagtaaggatacacccatggaagggacgttgaaaatacagccctcggcggtggcacccatcgttccggaataatttacgcagatagccatattccccccgtggttgataccggagactaacagatcgggcttgcgctccataacctcattaatcgctaatttaacgcaatcaaccggtgtcccggtgcaactatagatggtaagtccttcctcctttttcaacaaggtatacttgataggaactaaggatgtaatggcactacccatcccggaacgaggtccatcaggagcgaataccaccaaatcgcctagatctttcaggcactcaatcaattcgttaatacctttggcccatacgccatcatcattcgtgatcagaatcaacggtctctcgtttgtcatatcgttttatccttatagttgtcgtacaaaggtaacaataatttgcgaacaatggttggggtgtgaggggtgggagttgtcctttcgcctaatcagttgttgatcaggcgaaaggtctcagattattatagtttctctatttcttctatggagaggccggtggcaaaggcgatttgctctatactaactcctaatttcttaagattaagtgctatggagtgtttctcttcctgtcgtccttcagcttttccttcggcttttcctttttgcaatcctttttccatgccttcttccatcccttttttcatgcctttctcgacggcgaagtccaaggtgttataataatcattatacatcttccactccgcctcgtactgcgcccgttgtttgggggtgaggtttgccatcgatccgatgcgctccagtcgctcgaatatggccttgcgtgccttgaatggcattctgtctaatgtgtccatatgctttagtacataaatccaacgttcaaaatcagtctcgcattcttcctcctctttgttgaatcgaggaagctcaatatagatctggcggaacttggggttgaatacctgtccggtctctcggtccgccagcacgatgtcccttcggaactttccttcgttcctgttattgtttggcctgttcttctcatccagcgtgaagttcaagaagaagacaccgtacacggccgccagctcatagtcccatgttccctttatcccctgttccaccaccgagtgcgagaggtaatacaaggccctgtctttgaagtggggctgttccctgttctgcatctcgattatgatccgctcgcctttgtcggtctcgcaatggatgtcaaagatgactttcctaccttgctctgtctcgggcaatcgctcattgttcatgattctcaagtccttgatcgtatgctccccttcgaggaggtcgttcaggaactcaattaaaatgtccttgtccatttccctaccgaatatatgcttgaagccgaaatcggtgaagggattgataaattttcccatagtgtttataggttttagtgattaataatgaataatagtataataagacggggcaccctgtcttccggttgtaaagatactacttttttaataggataggcttcgttttagcttttaagaaaacacgtacgagttttttcggaaacacgtacatgtttttcgaaaaactcgtacgtgttttttgagaggcataatgtaactactttaaataccggatcagccgataaatcgtggggataattttcttgaatgtatattccaccaagggatagtatggctaggcactacacgatctgatcatttcatattcgtgaagagatcttttcacctacgtgatacaatcgtttcgcataggtgaaaagattgtatcacaaccgtgaaacgatttcatgggcagatagagcaagctactgccgataatgtttgtattaaatagaaaggctcaacggtaacaactcttcgtaggcatctctgcgctccctttcacatccttcacaacatatcactgacataaagcaagttggccgacgtgaaacgtgtgataaacaaattgaagtgtagataaaagtacattgcgagattatcctcactatttatcgggtgagcctgaaaaagtcgattctccgggagttaagaatacaaaatgtcaaagtgttactttgatatagatatacaatgtacgcatgtacattagtatatgatagtaaagtttgtatgattaataaatgcttttctagtatagaaacgactagtttaaacgatcgattcttttagtcatttgcaaaggtacgcatttcttcgatacttgcaacccttccagacgatttttttatcgcttattctctttcttatcaataggataggttatccttcacgaaacaagcgattccttcaacaaacctcccgtttcgacgctcaaaaaacgcaagatttagacgatcgtttagactagtcgtttttaatggcaaacgacgattttcaattagtctaacaagttgattatcttaataaacactagtattaatattaatttatttattatgaacaaaaagatttctacgcttcttgccggtgtaatgctggcatctgcgttctctgtcaatgctgcgatggagaatggcaaatcttatttgctgaagagcggaagtagttatttgtccgctgagacagataagacttctgctgattatggcaaacttgtgtacggctcacttaacactagcgatttgaatgaagttgttgccggtacttggaaagtttcaacaaagactacttctggagctgttgtctacaccttcgtaaataaggtgacaggaatgacattggctgttgatcctactttggcgaaaaccgcgaccaacggtctttctggtgatgtgacattaggcagtggtacggtttctgaatgggcattcgatgctagtaaccacatgtattcttacttcaaatcggactcaatcgttttctttgataatacgggtgccctgaacaaaggtaagattgcggacttgtctgctgctttggctgttacagaagatgtaataagcactcctattccaataagtgcagatgatttaaatacattgatgtggtctgttgattctaaagacaattattttgcgttgaatatggaccctgaagtgtcaaaaggcaaggcgaatcatttgacagcgacaggacttcaagcggttagtgctggtagtggttatgttcaattgaaagctaaggacaaaaaggcggatgacaaacaattgtatgtagttgtcgatacggcttattatgaaggaactgagactagcggtcagttgttgaaatatacctatgacgtattaaacgcagacaatcgcttgactggttcttataagttcaagttcacttataatgtgaaagaagacaaactctatgttcaagtagcggaagttgcggataaattagtgaaagcatcgggtcaaactgacgagcagtttgcgaaggatatcaaagacaataataataattcttattggtctaatcaaggaaaaactgtaacgacaagatctgacaagtacatctacatggctaaattggacggtacgaatgtgttgacactgaatacgaatgagacggatggtggtactcctacctttgcttcacagaatattacggttaagacttctgctgactatagtagccttacattaactacgattccttctggtgtatacttgatccagtataaggctggtggttcttacaatacagaaaaggtaggttcttatgtattcgctaatttggctggttatttcggttgggctgctcaagctcgtaaccaagagttcaagcatatgccggctgctcaatgggtagtagagaagaaaggtacatcttctattgcgccgatctcaattacgaaccgtgagttctctgatgatagctataagacttcttatcaaattccttctgatatgcaattattcgcagtagagggtagtgctaatgaggtattctattttaatggaaaccaaaaggatacggttagctttattaaagttgacgaggatcttgtaaaggatgctaaactgggatataagtatgtatcagaaaatgaagctaaggttcaaacttatctgtttaactatttgcatggattggcattagataaatatcttaatgttccgtcagggaaggattctattgtacgtgtagatgagactggagctaaagcaagtttccgcttacaagtggttgttaaagacgataagtatggttatggcgatggtttggtaagaaatgtttaccgtatcacggacggaaaaggccgttatttgacttatgacgggacaacgaagaagtatatgatgaagacttatcctactgattatttcttgaaagagaataatgatatcgaaggaaaagaatattatactttggttgaggctaatttgcttaatacatctatgacacaggcgcaagcacaggcatggtatccagaatggtgtaagggtatggctgtcgcagatgcaatgactatcgaggagcaatatactccggagggaggatctgctacttatgtgactgttggcggaacctcttatttggcttatccgggttcttctgatattgttgctgtagcgatgtatgataaagacggccaacgattggtagatgataatagtaaggtagactactatacttatcagaatgttaatggtaagattgcgttgaagaaagtaggagctgctcaatatgcctctagaaattacgcttcagtgaaggtctctgttgacgacaatacgttggatttgactcgtggctctttggatgataaattctatagcaatcaagagattcgtacatctgcttttgccgtagcaatggatgattctcctttgtatcgtcgcttcaacaacgccgctctaggtgagaatgtaaatgacggtcctgatagcttgacattcgttgagagcgttcgtaatgagtacttaatggatgagtggaacccgaacttgactacggaaactgttgattacgctggtatctggaataaggataaggctgagggtaaattagcgttccgtattgatacggcttggttgaatcgtggtcttggaaatatcaaacctcaatatttgatctccgtggctcgtgacgaccaagagggtgttgagacagttccttgtacagaggctggtcctcacgttgacgctaacggtaacattacaacagatccttctaagtgtgttcatgctcaacatggtcgtgctggcttcgcttatggcaaatacttggttaacttctcagactctgcccaagcgttcatcgatagagaggctaaggttaatccttatatgttcacaacgaattctagtgctaatagcagctatacccgtgtaggttttgttaaggctatccatgctggtgacagcttgttcgtattgacaaatggtttcgagaatgtagaaccggctaagttagatacggcgacaatcatcgctaactataagaaagctaagctggaaaacttcatcgtagacttggttggtgacaaacataagaatgtaacttggtcattccgttatattaacccggataaggctggtgccgtaacagaagaaggtgcagagaacgcattcttgttcgagtctaatgtttatggcgagaaagatcaaaattatagaaccgtaaatggtgacgctgatcgtgctatcgctccgacatatgctgccgcatggttgaaaatgcataatggttgtttggtactgacagatatcaattcacagttctcttccgcaaagaccaatggtgatggcgcattaatctttaatgtcgctcagaaggatgaagaagatatggttacatctaatgataacatcaacaatgttgaaggtgtatctgtagtagctggtaatggtactgtaactatccaaggcgccgctggtaaatcagtagttatctctaacatcttaggtaaggtagtcgctgagacggttcttacatctgataacgcaacaattaccgtacctgccggtatcgtagctgtagctgttgatggtgaggaagctgttaaagtggttgttaaataattaaacaaatagataggtcaagagatggggattcccccatctcttcctttaagaagatatttataattctgaaattcccgtgtggagatagattcttcaagtacaccgcgatggtagaacatgcgggagtattaatactaaagtaataaattaaaagctcaggtcacgagaacttctgtgaagaaatgtcgtgacctttttttgtactcttaaatctcgtgctatgcttatatctactcaagaaacattgatctataaatcaattagtccggaagacatttattgttatactcccggaatcaccgtgacttcgacgggacgcttggtcgtgactttcgacttgggcggcaagggggtaaaagaaatctatgcttcttcgcagctgtatacggaaaggacaagacggttaggtatcggtaagatttttgtatcggacgaccaaggcgctagttggtgttttatctcggattttaatttttggcatgcccgccctttttgtataggggaaaagatatatatcataggaaacgcaggcgatttatgtattatatgctcggaagatgatgggaatacgtggagcgttccctcgtttctctcccaaggtgagaaatggcattcttctgcctgtaatgttcttttcgctaacgagcgggtttacttggcgatggaacagcgtttttataactcggagatagaaggctggaatgtggcgggtttgagccctaccttgctatcttgctatattcacgatgatttactggatgcgtcttcttggcgacgttccgatccttttgttttcagggataaagtacatttcccggaaggggttggcattcctttttacgagtcattgaccaataagccgctagaattggctcccggtcgttttaatgcgcccactggatggctggaggctcaagtggttcaaataaaggataaacatcatatttggtatgatccggaagggaaaacgttccatatgtttcttcgtgcgcataccggagggattggatacgcttgtttattaaaagtgagggaagataagaacggccagatggtaaccggctttcaagagactccttccggacagaccttgcttttcttgccctttcccggtggccatttgaaattctttatagtgtatgatgagatatcccggttgtattggatggcatccaatcaatctttcgattctatgcggacgataagctcattacctgagacttcccggtatggactcccgaataatgagaggcatcgtttacaattattattctcgaagaattgtgtggactggtgtatggctgggatgatcgcttgccaagggaatgaattatattcaagaaattatccttcgttatgtatcgtaggtgaggatatgcacgtggtttgccgtgcggcggatgatcatacaaaggaccctcaatactctgattgtattacatattataaaattaaacggtttagaatgttaatctattaaatgaagtgattatggaaaaagtactgattgtaataccggctcgatatggttcaagccggttgccgggtaagcctttggttaagattaaaggtatagagatgataaaacgggtctcggatatagcggattttgtatgtcgcaaaaatgagtcttgttcttatttggtagctacggatgatgagcgcatcgtcttgttttgcgaatcccgggagattccggtgatgatgacttccacgaattgtaaaagtggtacggaacgttgctatgaggcggtaaggaaacaggacaccaatcccggactgataataaatctgcaaggcgataatcccacgtgtcctccttggatattgcaagatctgatcgatacatggagaaaggagaaggcggatgtccttaccgcctcggtcttgttgggatggagcgaatacgatcaattactggcgatgaaaaaggaaaccccttattccggcacgacggtattggtggatcggctgggatatgccttagctttctcgaaacaaaccatacccgctatccgtaaggaggatcaggctagggatcttttgcctaaaagccctgtcaggcggcatgtgggtttatatgcgtatagcggtcgagccttcgagtcttatttctcattacctccgtctgtgtatgaacgctcttatatagaaggattggaacagatgcgtttcttagagaatggcatcaaaatgagggtcgtagacgttgattatcggggacgtgagacaacaagcggggttgattccccggaagatgtcaaacgggttgaggaaatacttgagaaatatggagagttcgatctttcgtgacttagatggaatcgtagattctattttatttccttaccatactttggaggaagttctacctcctggctgtgaggctggtccggtatggatggaatttgcctgttgggtagacagccaaaaggtggatatacgggcatcggaatcacccttattcttgaatatatgtggtatacccgcatccggtaaatcgtattgggcggaggaatggctatcagagaatggaccttgtttgcatatcgctttcgacgctattatggaggcattatccgggtatcaagcggattgctcgctagatagggagaaagcgttcttacgttgggaacttcctgctcgttttttaggttaccgtcttcttttgttgggattgaggaatgggtggcctattttatttgaacatagtaatgcgttgagagaacatgtggatttgtataagaagataaagagtcttggatatcggattcatatggtgtgcatcgatgcgacaccagaaatggttatcaaaagattggctcggaggaatcgttttttcccggaggagcaagtaaaaaaacgttgggattgcttgatagatttgttacctgaatatcaaaaaatagtagatgactttaaattaatacaaccatggaaaaatgtagaaaacttgtgatcgtacggcatggtaatacgtttcgtgcgggagagactccgactcgggttggagctagaactgatttgcctctggtagaggaggaacgagctagatctgcgggacgttatttacgtgaaaaggggattgtgatcgacaaggtgatttcggcccccttaaaacgcacattggagaccgctaactatatcttggaggaaatgaatgtggatttgcctatcattcaagacttacgtcttaaagagattgattatgggccggatgagaatatggtagaagatcatgtaataaaacgtttgggatctctctatttagaaaaggagggaatggaccggaaagacctaacggaagatcggatcgtggagaggggactttccgtgatcgcccaatggaatgagaaggccgtggtaccgttaggatggaacgtagatgtagagaaactgataagcggttggcaggatttggcggctagtatacctgatggtgagacttggctgctagtatcttccaatggagtgatgcgtttctccccctatattctggggaattatgaggatttctgtgcgactcatgatattaaggttccgacaggtggggtttgtatattcgattgtgtgggtgatcattggaggtgtacggattggggaataaaggcttataaactttttaaatgataaatcatggaagatatatggaatataacagctttggtagttagtgtattaagtgtgcttttgtctctttatgctttaagacaggctaccactaaaaatacctcggatatgtatctgttctttatctcgcaatatgcgaaggaggacatgaaattggctttacgtaaattgaaagatataaagcggggggtatatcggttggaacaatgggagagtgatatgaaaaataatttgccgaaagcctttgagtatgacgaggcgagacgtttggtgaaatatttttatgatactttagcctatatgaagttagagaaactgatagaggcacgtttcgtaagattgatttgcttgaagaaaggagcatggctttatctggatacagtcgaagccatggaaaagttttttgacagtggctatgataaaaagccatatgcggttattcgggatgtatgcgaaaatttacgaaaggaagggtgttgtcctccttagttcattattttcggcttttggtgatttaataaagccttgatcgaagaaacgatcggggcttttatatttatttcttaattcgccatgacgatattccgcaaatcgaaaccgaattgaatatactcatcctcagtgatttgcctctctgtagtcaggatgattaacgcatgccctcgatagttgtttctgtaagggggatggaaatggttgtaacggttttcgaagaagccgcattttttatagaactttaatcgcttggaggaaatttcatccgtaataggatcgatctctaataagatgatcttattcaggcgtttattaaaatcctccagcaataaaccgccgtatccttgtcccctaaagttctcatgaatggcgaaatgttcgatatatacataggtgctaaaatcccagtatgagataaagccgataaagaggttatctttcagataagccactagatgatagttgggagattggaaggcctgttcttgttgttcttctgttcgttgctcaaatagagggaaacttgccgtatatatttgctcaaaggtaggatagagaggatcttgcttttgcgttatttctagtatgtccatatgacttcgctttattttgatgcgaagataataatctaaaaacattgtcatgtcatattaaagctttatttttggatgatcttataattaagatattgtatacgatgatagcgtggtttcgttatatatgtttaattgttagccttataatcactatgccggaattactttcggcacaacgtctggtttctcaacgtcaagaggatgtagaggccggtcttttatataacgagagcgtctacatcctatctaattattcttgtctatcctccaattccccggaaaaactttctttggacgagttgttgcggaagcagatcgaaggcttttatttctatttgaagcgggatacggagacaaatgtattgttactaaggaaacctgatggtacgtttaccccttttagtgagtcattggaagccattaagacggccttggatgcggactccactaaggttatgacgcttttccttgatttctatgtagagacggagctggaatcctcttttaaggaaataggcttgatggagtatgtacttgagtatgatacgaaaaacggatggccatccctgaaggatatgttgagttccggaaagcgactggtcgttttcgaggttcagaaacatttgaacagtccttcatggttgcataatatgagggatttcgtggagcatacggacgctgattggggaaaccaaccggaaggggttgagagttttgatgagcggctgaaaaagaatttgtctttatttaccggatataagttcttggagacttcccgggggaatagcaatgatatctcggctttagcccggcagacgccctatttaattgaatcgtttaaaagagcgtggatccgggatggaagggttcccaattttatcttggtagataagtattacgcatggttggatgtctcgttggttacttttcggaatttcgatatcatctacggcgcggttacgaataacaatgagctgcttaactacgtgaattgggatgggatgtctaattatacgacgggtaaatattgctttccgctagagcccggagccgagttgatgctttcgccgatctctccgggctatcggatagagccggctacggtttatgtctccggtacccaaaggaaggctttcgccggcgattttaaggctagacctttgcggattgacgaggatatagagatttatttaccgtttgagggcgatgagaaagatggttcgtccaatcataatctcacggtatctaggaatgtcgagtttattcaggaccctatacgggggcaggtcgcttccttggagaatcaggcccgtgtggatttgccgaccgcttcggaacttcatatgcgggatcatgatttcactgtcggcgtttggttgaaaatacctaagtacctgccggagaaggaggattattgtattctgggagctaagaacagtacttatcaacaagcgttgcatctgttgatacggaatcggaaaccgtatatgggattctttaacaacgatctggttggtaacacggagatcgagccgggcaaatggtataatgtcgtatggcggtataataagcggaatggggagcaggctatattcgtaaatggaaaactggatgcgatctcttttgatcgtccggcttatctgggtagtgatagcttatatgtcggtttcgtgaatttcagccagtcctcgaacttcgtgggtgtgctggataatctttgtatttggtctcgtgtgttgagcgataaggagatattgggattgagcaaccagttattagatttacatatatcgaatgcgattacttggttggatgtccttggaattgggttgattttgatggttctggtctcgatagcttatctaggctatcggaaggtgaaagaaaagccaaggcaggatgaggctgatgcgggaacggttgcggaggagggaatcgaggacggaatcgaggagccggatcgttcttcgcaagagatgccggaggagatcgagaaggttccggttctgcgcaattatatccgattgtttggagagttctatgtgttggaccgggatggaaatgatataacctctctatttacccccaaattaaaacagctgtttatcttgattatgcttcactcttcccgtggaggtttcggaatatcgagcaaggacttgacacggatgatttgggggaatgacaacccctcgaaaagtacgaagagccttcgaagcgtatctatattgaaactccggaagatattggaacgtatcgatacggtcgaggtcctatttaacgcgaatcgatatattctccagctttcggaagatgtctattgcgattatttggcttgtttggattggctgaaagataaacgggtacggactcagccggactttgaatatttctatgatattatcagcaaaggagaagtgttcaaaggggaatcgtttgattggatggatgattttaaaagttatatctgtaatagtacggtggatgtcttgtctcgctttatcgacacttactcgatcgaggatgaggcggatcgggtgatccagatagcagaccagatccttctgaacgatccttgcaacgaggaggctttgctctataagatcaaagccttgatttaccagaacaacttcaaattggcccgttacgtgtacgaccgcttttgcgctttataccaagagatgtatggcgaggctttcacctcttcttttgagcaggtcgtaccgtcttcgctgatgagtcagcaatctccccagtaatattatagtgtgcctgctcattggcagactgtgccatcgctattgtcacacctgtgccatcgttgtggcaagaccgtgccaccgttatggcatgcctgtgccatccgtgtggcactcctctggcattacagtgacaaatgtatgcaccccactgatagcgatcctttcgaatagggaggcaggtgctatgcctctgacttatcgaagatttttataaatatttcttgatttatttatgtcgctgttattgcgtgaattatgctttgtgcggatatgaaatttgccttaaattagccctaggttaatgccttgtttagcgttcgttaactcatggtttactgctcctccctatattcgctctcgttgtttcgcacgaggaagcgaagttgtgttttactatatatatttttttttcgactttaaatttaatactatgagtaacactatgtctgacaagaattcggtgaacttcacacgtagggagttcttaggtacagtagctgcagcggcggcgtttacaatcgtacctcgttccgttttgggtggaccgggctatacggcacctagcgatatggtcaatttggccggtatcggtgtgggtagccaaggtggtggcgatatacagaatatcgctactccggatgtacctattaaaaggagatcttttggtggaggcggtatgctgatgcaaccttatgcgggcatccagccacccagacgggaacgaagagcgtcggataatcctgtgcaaatgggagatgcggagaaacaatcgtttaagcatgcgaatatttatgcgctatgtgatgtagaccacgattactccggacatatcttagcgggatacccgaaagcgaagaagtataccgatttccgggaaatgatcgacaaggagaaagagatcgatgcggtattgatcggtactccggaccacacccatgcggttattgccgcttatgcgatgaaagcaggtaagcatgtatttgtagaaaagccgatggctaagacgatttatgagacccgctttttgagggatctggcaaagcaaaccggtgttgttacccagatgggtaaccaagggcataatattgaagggactatgcagacggtcgaatggattcaaggtggtgtgatcggtgacgtaagggaagttcatttgtggacaaaccgtccgatgtggcgccaaggttattttgatcgtccggcgggagtggatataccgtctaatcttaactatgacgtatggttgggtccggcccctgataaaccttataatccggagatgcttcatttcgcttggcgtggattatgggattacggtacaggcgctatgggggatatgggagctcataccttcgacgctccgatttgggcgcttaatttgggtatgcccacgaaaatacaagctacttccaccccttacaataaggactatctgccacaatcggaatgcgtgacgtatgagttcccggctcgtgggaatatgcctccggtaaaggtaacttggagtgatgggggtataaaaccggctcgtccggcggagttggaaccgaaccgccagttaagggaagcgctttatataggcgataaaggtctgatcatgcatggtacccatggagcggagccgcaactgataccggaaagaccggggttcgtagctccggcgaagacattaaagcgaccgagtaatatttatgtggattttatcgaggcgataaaggaaggtcgcaaagccgctaatgattttgaggtatccgctaaattgacggagattatgttgctgacgaatgtcgctgtcgctgcgcaacggttggatcttacgttggaatatgacgcagagaatatgagaatcacgaattgtccggaagcgaacgattatttccactatgagtatcgtaaaggctggagcctgtaagggactttcttctaagggttaagattaatttataaattgaatggttatgaataaagatgtgaacaatggtcagtccagacgtgagtttctaggaagatcggtcgctgctttggcggccgcgtctttccttccgagtgctttctcttgtacggggaagagtgtggcggctcccgctccggttgatacggcggcggaggcaggcaaggttaactcgaagttcggtggcgtgcaaatcggcacgatcacttatagttggcgttccatgccgggtggattggagaatatcatcaagtattgccaagaggcgaatatcagttccatcgagttgatgggaggtgatctggaagcttatttaggagctccggagaatccgatgatgaaattcttccgtcagcaagctcctcaacccgcggcgaaaccgggtgagaaacctgcggctcctcgtcggatgggtcccccgaagtttactccggagcagcaggctgagatcgataaatataaggaagaggtgaaagcgtggcgtctcgggctggatctatcgaaggtggaaggtgcccgtaagttattgaacgaagcaggaatatcggcgcatatcgtgaagatggaaccttcccgtatgggttcggacgaggaaatcgattatgcgttcaaggtagccaaggccatgggcgctaaagccgtgacggacgagattaatttggagacggcgaaaagagtcgctccatttgccgagaagcatgggatgtatatggctttccataatcatatgcaatatgccgaagaaggctttagttgcgatccgatcttagcggtctctccttctattatgttgaattttgacgcgggccacttctttggctctacaggtatccatccgaatgagatgatcaagaaatatcatgatcggatctatagtatccacttgaaagataagacggggcctacgacaggggaccagccgaatacgaatcaagtatggggacaaggggagatgccgttggaagacgtgctcttgttgatcaaacaagagaaatggcctatctattgcgatatagaactggaatatgatatcaagccttggtctgactccgtgaaagaggtaggcacttgcgtgaaatatgctcgacaaatattgatgtagattatagaatgttgtctttggtatgtcattaataggtataacgaaagggccggttcctgatggagccgaccctttatttttcatttattgatctctttcagcaaattgggcgcgcacttaaaatggacaatggttctggggatcaacattaaagtctctccgcttttcgggtttctagccaacctgcttgtctgcaagcggggagtataaacaccgaaaccctgtatacataccttttctccggctctcgttttctctaagatgatgttattcagttcttccaatatgtaccggatttcttctttgtcattaccgactcttttcgataattcctcgattagctgacttttattcatatcgtattattttttgagaagtttgttctttgctctgttgttaaatattttttcctgtattgcaaaggcgataagcccgtgtgcctccgaaagaagcgtcccaacgaagattggttcgagaactgcgtcttctcaacaatctcttggatattcaaggtagagttggtgagtaatccttttaattctaggatcatatattccgtaatccaatctttggcggatttgccgcttacctccttaacaaccatggtcaagtatttaggggtgatgcatagagagttcgcgtagaacgtcacgcttctgttcactttgtaattactcatgaccaattgaaaaaatttgtgggtcagttctttcttgtgtacatctatcgttgccgtactgtctaaagaattgactttataatggttatatatatcaaggaataatatgcgaagtaagagtataaccgactctcttcgatactggttttccggatcgacggcttttcttataagtaattcaaagaagtctacaaaggaaagagtttccacgtcttccatcttgaaatagtaatgttgcctcatatagaaaaagaaatgtggcgagaaacgactgataccgcttaatatatcagtataaaaggattccgtgatcgtgaaatatctgatttggaaatctacgctaacgtccgttaatgcgaccaattgccccggcaagatgatgatgagctctttaggggttataatgtgcttgttggaatagatatcaattttagcgtttccttttacacaatagatgacaatccctaatcttatataagaagggtaagtggtaatagggagttctttggaaagtgtaaagatcttgaagtccttctccaaagaataatcaataccactattcggctcaactatttttttaatatttcccgacattctttttgtctatgtttcttatgtaaaattataacttcgtcttttactatatttatctagtggttgtttggtataatattacagaaatataggtctcgttttggcgttttttaaagtttggtttaaatgataccttgaaaaataaccgctattggatgtttttgtttgtaggtctaatacttttttgcaaatacggttgaggtgatgttagggataacttgtattctaagggctgtgcgagctggatggaatatgtgttaggaaatattagtaattcaggttaaggacaagcgtgcgagacaagaacgggaaggattgcctcgcacggcaggcttaggtcgtcttttagataaacttgagtatatcttctgccttttccgctatatgatcgggtgcgtatttctctaattccgtacgagggcgaaacccccatgttaccccacaggaggtcacttcgctgttgatggcggtttgcatgtctacgtccgagtcaccaacataaagagcgttctctttggatatgctcgctcgttctacgatctcattgacgatactgggatctggcttcgcctttactccttcacgctgtccgagaacctccgtaaattgtatggaagggaagaaatgggcgatgagcttacgggtagcggcttgatatttattagaagcgaccgccagttttatccctctttcctgcaacaaggctaataactcagggataccggggtagggaacgctgcgatctgtgttatgcagatcgtaatgcttcaagaactcttcccttacctttagtatattctcttccgtcttttcaccttcgggtaacgcacgttcgaataatttgttgatgccgtttcctacgaagaagttatactcctttacgtcatgtgtcggaaagccgttttgccgcaacgcatggttcgtgctatgggctaaatccgcgatcgtatttaataatgttccgtcaagatcgaatattactaactttttcattttagttttctggcaaaattaatggaatgtagagatatactttccctttcgactgataaaatagatgaaccgatttaaaaatagataaaagtattaggtcatatataagatatttgtatctttaggacaggaatagaaatcctttgtaatatattgtataacctaaaattggaacatcatgggaaagaatcaattaattcacgggaatgaatttcatttgctgaaacaagctgagattcataaagctacaggtaaattagtcgagtcactaaacttggcagccggttctacgggaggttttgatctttataaagttgtagaggcttattttacggatttagagaaaagaaaggagatcaatgatttgttgggtatttccgagccatgtgagacacgtgtcacggaagaatgcttttcttaaataagccgcagtaggaataacatagaaaaaggagatacctgaatcagatatctccttttattatatctcaaagaaggatcaattacttaccagaaagtttttctttcaaagctgccaattcctcgatgtcacctaatgtagtcttttcaaccggaccggttaccattccagattcctcttcttttttaccgccacgttttgaggaagccttcttttcagaagttgccttagcgcctttttgctcatcttcaaagatgcggctgtgagaaaggatgatacgtttagcttccttgttgaactcgattaccttgaatgaaagtttctcatctacttgagcttgagaaccatcttcttttacaagatgcttcggagtagcgaaaccttctacgccgtaaggcaaagagataacggcacccttatccaatacttcgatgattgtaccttcgtggatagaaccaaccgtgaagattgtctcgaatacatcccaaggattctcttccaattgcttgtggcctaagcttaagcgacggttttccttatcgatttccaatacttgaacctcgatctctgctccgatctgagtgaattcagacggatgtttgatcttcttcgtccaagacaagtcagagatgtggatcaagccgtcaacaccttcctcgatttctacgaatacaccgaagtttgtgaagttacgaaccttagccgcatgacgagaacctaccgggaagcgctcctcgatgttttcccaaggatcagccttcaattgcttgataccaagagacatcttacgctcgtcacgatccaaagtcaagattacggcctcgatctcgtcaccaaccttcatgaagtcttgagcggaacgcaagtgctgtgtccaagacatctctgaaacgtggatcaaaccttctacgcccggagcgatctcgatgaacgcgccatagtcagccataacgacaactttacccttaaccttgtcaccaaccttcaagttcgtatccaaagcatcccatgggtgcggagtcaattgcttcaagccaagagcgatacgtttcttctcgtcgtcgaagtccaagataacaacattgatcttctggtcaagctgaacgatttcttccggatgagaaacacgtccccaagaaaggtctgtgatgtggatcaaaccgtctacgccacccaagtcgatgaatacaccgtaagaagtgatgttcttgacagttccttccaatacctgtcctttctccaatttggagatgatatctttcttctgttgttccaactcagcctcgataagagccttgtgagatacaacaacattcttgaattcttgattgatcttaacaatcttgaattccatagtcttacctacaaatacatcgtagtcgcggatcggcttcacatcgatctgagaacccggcaagaacgcttcgataccgaatacgtcaacgatcataccgcccttcgtacgacatttgatgtaacctttgataatttcgtctttttcaagagcctcgttaacacgatcccaagaacgtgtagcgcgtgctttcttgtgtgaaaggatcaattgtccttttttgtcttcttggctctcgatgtaaacctctacctcgtcaccaatctttaaatccgggttataacggaactcggacataggaacaacaccgtcagatttgaaaccgatgtttacaacaacctcacgtttgttcatagaagtaacggtacccataaccacttctttgtcttttaccgtgttcagggtctcgtcatacgtttttacaagatcgtccttgcttacttcggtgtaagtctcgccttgctcgaaagcgtcccagttgaaatcttcaaccggctggatgttttttaaattttccattctttaattgttaatactaagtttgttttaattagtaagttagactttatgttgtcatctctcaaaaatcggggcaaaggtaatgctttttttctgattgacaagagttttgaggggtaaaaacattcaattgggccgtgttggctgtaattacggaaaactgttgatttttattgatatttattttgtaagtttgcgaattgtaagcgataaatcaatgagtagaggatttttaagaaagtccagcgtcaatacttttataggaatagtgtggattttgtttgcggtgagcgcaagtgcgcagaatgccgtgagtaaatttcgtgcggatagcatacgccaatctttatcgtgtatccaaaaacctcaggataagataccccttcttaaagaattaatcggcttgtactggcaattgccggaggaggtaccagcgttgaaagagataatcgatatcgcgatgcctttggattccatcgggatcgtatacgatgcgatggctggcttgagtcgttattaccctgctattaacgtttgtccgagtcgggggcgctcttgaaacagtatgatcatttattggattccttggaaaggaagtataatggggagggaaagatttttccggtaaaacgtcatcgttgcttgatgagttgctattattgcgagctgtataccatgaaagggaattcgggaaaggcacaggcgtatttggatcaggcgaccgcttatttggatagttcttttggggatagggtggaggctcaatatctgcggacaaaatcattttattattggaaggagaaagattataggcatgcgttgtccgccgtcaatctggctttaaagatcaatcgtgatctggataagttggagatgaagaaagcgatattgcaatcgtccggccaattgcaagaggcggtcactatctatgaggagatcatcaataagacggagacgatcaacatggatgccttcgaccggcaaatcgagcaactccgtgtattgaatgacttgaatgacatggaaaagcaagatcgggagttgaagctgaaatcggagcaagaagctttgaagcagaagcagattgtcgtatctatcggtcttctattggtcttgatgggcctactctatatgttgtggcgtatttatatgcatactaagcggttgagaaatgagttgcttcaggagaaagactccttgatcgcttcggagaagcaactgagggtcgtgacgaaagaggcggaggcggcgaacaagaagaaaagcgcatttatcgccaatatcagccatgaggtgcgtacgccgttgaacgccattgtcgggttctcggaattattggcgagtagcgagtatagcgaggaggagaagatccggtttgccggggaggtgaaccatagttccgagttgctattgaatctggtgaacgatgtcctggatttatcccgtttggaatccggcaagatcaagttcagcgtgaagccaaacgatctggtcgcctgttgccagagggcgttggattcgattcgccatcgggtgaagcccggggtccgattgacgtttactccctcgcttgaatcttataccttgaatacggatgccttgcgtttacagcagttgctgactaacttgttgtcgaatgccgctaaattcacctctgagggagagatcaatctctcgtttaccgtggatgagggcaaggaggaggtccgtttctccgttacggatacgggctgcgggatcccggaggataagtgcgaaaagatattcgagcgttttgagaaactggacgactttattcaaggtaccggcctaggactatctgtttgccagatcatctcggagcagcttaatggctctttatcggtggacatctcttataaggatggagcccggtttgtctttatacatccaacgaatttaattgagacccccatatgagacagaagaatcgactcaataactggatatccatacgtatggggatggtcatcgtgatcttcctaggcgtatcttgcggttcgatgaaatcttccacacctcctcccgccaaggatcgtttaacggagatcgacagcttggagaggttattgccggactgcccgacaatagcgtctaccttgcccttattgcggaggttggcattcctgtaccagcagcaatccgagatgaaggtttataatgaacgtctttatgaaaatgcgatggcggtggattctatatctgtcgcatacttgggattgaagaacttagccgaatattattacgatcagtctgtacgtgatagtttggaatattattgttctctcgtagactccatagccaaggcccggcatgaatacccgaatgtgttgtttgacgtgaagagcctttcctgccaagatctcctttggcttgggaattatgagctgacgatgagcgaagctatggatctgtatcggttggcgagcaacttggatcatagatatggcttgctccgttgctcggagacattaggattgatttaccaacgaatccggagggatagcgacgctgtcgtctcttttcaggaaagccttgatttattgaaggatataaaggatgtgccggatatcatggatactaaggtccggttaacttcttatcaattggagagtagcgtacggacgaagcaatacgcgtcgacggaacggatcttagggcaatataaggctttgctcgatgagcagtataagatctaccaagagaaaaacgatcttttgtctattaaaagagaatattggttactttattctttttacacgagtttttatctttcgcaaggagacttggagaatgccaagcgttcgttggatcaagcctcttcttatgcggatagtaattgggttgagggagattatgcgatcaatacctacctggcggttaaggcccgttatcataaggcggcaggagacattccgctggcgcttcattgtataaatgaagtgctggagaccgagcggctgcccgaggatatccagttcaaggcggatatcttgaaggaacagggactacttggggaggtcatggctctatatgacgaactttatagtacgctgacgaaaaggcggggaacttcttttctccggcaggtaaaccaattgcgtaccttgcatgagctgcatgaaaaggagttgaaagaaacggaattgaaggaggccgggcaacgcatcgcccggaaacaggatctgctgatctttatcctatccatatcggtcgtgctgttgatccttctctatgtcctgtttttgtactaccgtcatctacgatccttgaagaaccagttgcagcgggagaaagagttgcttttggaatctcaaagacagttgataaaggaaaagacccgtgcggaagaggctagcttgatgaaaagcgctttcctggcgaatatgagccacgaggtccggactccgttaaatgctatcgtggggttctccggtttattggtggaaccttctaccgatgaggaggagcggaaggaatattcgtctatcatccggaacaacacggatctgatgttgaatctggtaaacgacgtattggacttatcccggatggagaccggagaccttcattttgacatcaaggatcatctgcttttagtatgttgccaaatggctttggagagtgtacgccaccggataccggatggggttaaattgactttttctcccgccggggaaccaatcgtggtacatgtagataatctgcgcctgcaacaactgttgacaaacgccgctaaatttacggagaaaggcgagattaatctatcgtttcaacttgagccggaccggaagaaggtacgtatagccgttacggatacgggcgccggaatcccccttgaaaaacaggctaccatattcaaccgctttgagaagctggacgattacaagcccggcgtgggtttggggctctctatctgtctcctgatcgccgagcggctggacggcgccttgtttatcgactcttcgtatacagacggggctcgcttcgtgcttatcctttcttgtgaaatagattcctcaatttataatccgccaatagaagtatgagcgtgatggcccctatgtataaatagaaagccaaggccgatgtgcttatcgtggggatggctatcttgggtatctccatatatacgaaagatacgatcgcgagggaaatcatgataagcgaggccacgatcgccgctaacaggctgaaccgttcgtcacgtttcttcgcctttgcggactcaagcatgatttgtcgcattacgttcgaacggaacgaggcgggaagctcctcctccggtatgcgtttgaataaatcccccaataaatcgggttgttccttatttgtgtttatcttactcatgatccattccatttaataatacaaacaatttttttcggatgcgatgtagcttgactttaatattcgaggcggtcaagccggtgatagagaccagttcttctattgttttttctttccaataaaagagcaagatcaaggcccgttcgtccggtagaagttgttcaagggcgacttccaatctttgaacctgttccgtggattcggtttgtccgaacaggttcgtaatttcctcctccgatacgttttcaagtgtagtctcctcaatcgctagaaactcatatctcttcttccggaccgacgagatcgccgtgttgtaagcgatccggtaaatccatgtggagaaactgcaatcccctttgaatgaggcgaggtttttgaataccttcataaacgtatcttgcgccaactcctcagcctcctcttggttttgtaccactttgaggatcaacgagttaatcggacggctatacttgtccaaaaggcaaacgaaacatgccacgtcccccgcttgtatcctttgtatgtaatatgtatcggtatacaattccattgtacttaatggacgcaagccgggtaaataggttacaacttgcggtaacaaaaataaaaaatatttttcagcccggaggtgtaacctatgggaaactgttgcgtcaaattagcaaacaatatgaatgaatcaattaaaattatacagttatgatggattttatttctgttccgctagttgtcggaatcgtttgtgcaggtatttacggattatttgagttgtttgttcgcaagagggaacgtttggcgattatcgagaagatcggtgataaactggatgcctctgctttcgatggtaaattgggactgcctcactacatgcgaaacttctcgttcagtagcttaaaggccgggtgccttttggtgggaatcggattaggtttgttggtaggctttattattaatatgtgtatggcgacaaattcttattatgatgatggttggtacaggcatgaggtagcgggtacggcttatggggcttcggttcttttgttcgggggaatcggcttgataatagcgttcgtcattgagctgaaactaggtaagaataataaatagccataggcttgcctgtatagacgtagcgtgctgcatgcagcacgctacgtctatactacaggtagatctccccgaagaattcaggacaatggaaattaggctcgggaaggtcgatcggactccaacttacgaaatgcggattcattgtctcatcggcgcatttatagaagttccctagtattttctccggcagattactaggatctaaccccatcaacttgagtggtatgactacgattaagttccatgtatgaatacctttaatctcctcgaatgcccttcttctcacggatgggagtcttatgatgcttttatactcttcttgcgaaagcgacgtcttgatatcccgtgaggtacggcgggcggcatcgcaagtcccgatacaattaaactcgaaattcatataatgcgagtcaccttcctttttcatgaagaattccacgcaactatccttatggaccgaggaattgtccatctcataagacgcctttagcgaattaccctgcacgctatatcgtatatatagatttttctctgtccgggctatattaaaagcggtgatcggcttatatggatactcatgccaattggcatgggtgaggaactcacgttgggattgcacctcaagaatcggttctatggatgttatatcgagtacatccagaacagggataacaggaactttcagtcttttcattttaactatagatttgaagtaaaggccattgtaagtaggaggtcaataaaaccgatagggcaccgataatagacaatacgataatgacagagcccacgatccggttcagtaaccaaatacctctaacgttgaaccattttctcagttttccaataatatatgttatgccgaaccaccaaagaacggcccctaaccctatgcaaacaatgcccaataccagcagccaaaacgaatgttcaggcagcacgaaaccaaaccgggcgaataatcctatatagagcaagacgattaacacgttgctaaaggtaagtagaaaagctgtaataaagtcttgggtgaacgataattttttttctcggtgtttctttaggttcctagtcgggttgctttggaagatataatacccgaaaatgccgagaacgatacttccgatcaattgcaggggcgcttggttcgcctccacgaagttgaccacaactcccatgcccagacaagtcagtgccgcataaatcacgtcggatagagcggcccctaatccggtgacgaacccgtgccaacgtcctttatttagtgttctttgtatacagagcataccgatggggcccatgggggccgaaaccaatacacctataatgattcctttactaacgattcctagcattaagttgagtctcttctagtttcttgggcaaagatacatccattccgcgataaaaaaaaggtaaaaaacgtaagatactgtagggacgaggctcgctcgtcccttatttcgggaaattgggactgtacaatagggtcgtatcgagagtcatcaatttaccgtctttcacgaatgaatctcctcgctcggacagatgctctaccatcatcttgcgtagttcggacaacttattctgataggctgcgtcctcactaaggttatgtgtctctcccgggtcttcccgtaaatcgaacaactgctcgcttccgttgtggaaattccagatatacttaatcttcccatcggtaagggctgcccagtaattatcgtcgctatagcaagtggcatgctccatgtctatataggggcgccattgttcctgctggccttggatcagcttgagtaaagaccgcccgtccatatcgggaggaaccgacccgccggcgatatcgataaaggtaggcaagaagtctctcagttctacaggttgttctatgctgcttccgtccggtatggatttggatataccggcgggccattttacgatataaggaatatgggccgaaccctcgtacggataggttttccgccaatgataatgatcgcccaacatatcaccatgatccgccgtgaaacaaatcagggcattgtcgtacatacctttgtcttttagggtctggatgatttgccctacttgatcgtcgataaaggtgatattggcgtaataatggcgacgggagtttatggcatacgcatccccgaaattaccgaatggggcatccgatgctccttggagaggatctttcggctcggcgtattgtccgcaccaatctcctatatggggtttcgggatatctgcgtccttatacatatccagataacgttgaggcggatcataaggactatgcgggcgggcgaatgataccttgaggaataagggcttgtcgttgtcgtagttccggatcaactcgcaagcggtctgtccggtccaagccgtaggatgaagccgttcgtctaacttatagacaccggcggcatggtcgttccagccgatacccgtaagatccgggtctttgccgggtgcctgcaattgaaaccattcccggtaatcgctgatgaaatcgggactttccacccggccactctcgtcgatcaaggtcgcgtggaatccgtgaagtgctttctgcggaaaccaatgcatcttaccgatcccgaaggtataataccccagattccgcatcatctgaggcatctcgtaacgatacttcaaggccatgcgtccgtatcccagcataccatgatgccaaggagacatcccggtcaataaaccggcccgtcccggagtactacttggagcggaggaatatccgctcacgaacaacgagccttcttgcgccagccggtcgatattcggtgagatcaccgccttgtttcccatgcagccgagggcgtcgccccgttgttgatcggtcatgatcaagatgatatgcggcttaccgctctttacgggcatggcgggagagacggcggtctctgcctctttcccgcttttgctatgcgtcatccccggaagtgtcgcacccagaccgattccgagggatgatttaatgaagtttcttctttccattatttagccttgatagtgtgatcccgaactccttttaagattccctgcaattggaaaacgatctccggatgttgcaaggccttgtttccttcctcgtagaccttcgtcatgtcgtataactgaggctcgggggaatatccggtctcaatcttctcatattccatgatagcggaacctacgctcggctcgatatatttccaatctttcgtacggacggagagtgccttattaagcgcttgctcgattacccacgggcggtcttccttgcttttcccgatccaagtatccagataatcatagctatccggcgcgcttccttccggaagacgggaattcgtcagtgaggcaagggaggcgaaccagtcgatctggctcactagcgcatctgatacggcggcttgcttgatctcctttggccaatgtacgatagccgggatacgggttcccccttcgaaggcactgtatttattacctctaagcggtccggcgggtttatgatcgcctaatagctccacggcccggtccgcgtaaccatcgtctacgacaggtccgttgtcgcttgacaagatgatcaaggtgttttccgtcaatcccatctcatccaatgttttcatcaattggcctacgctccagtcgaattgctcgatagcgtcgcccctcacgcccatcgggttctttccccggaaacggtcgtgcgggaagcggggtacatgcacgtcgttcgtggcgaaatacatgaagaaaggcttctctttattctccttgataaaatcgatggcgtgtgtcacgatagaatcggcgatattctcgtctttccaaagcgccttgccgccacctttcatgtaaccgatacggctgattccgtttacgatggattggtcgtgcccgaaactaggcttctggttgtataataattccggattatcttttccggtcggctctccgggaaagttcttctggtaactgacatagatcggggtgtccggatcgtagttcgccacctgcccgttctcgatgaatacgcaggggacgcggtctgccgtcgccgccatgatataggaataatcaaatcccagatcgccaagggcggtggggagtggggcgttccagtcttgctctcccgctttgtctcctaggccaagatgccatttgccgatagcggccgtggcgtatcccgcgttcttgaacatatcggctatcgtataacgctccggtcgtatgatcattccggcgtttcccgcggcgatgtccgttcccgggcggcgccatgcgtactctccggttagcatggaatatcgggagggcgtactggtagaagcggtcgcgtgagcattggtgaagcggatgccgttcttggcgagtcggttgatattcggggttttcacttgcgtgccgtcgtagcattccaagtctccatatcccaagtcatccgcgtagatgaacaatacgtttggcgttctaggtgtaatgtcttgtctctgttgggcttttgcgataccggctgtaagaagcgaggcaccgatccctacgataagtgttgatttcatgttgtttattatttagatgttctataaagagtttgtattatgactctatttcgttatcaaaatcaagaaggttatctgtctggtatttatcaaaatcggattggaatagacggtcttgaatgatacggtatttctcaaatcttttcttatcaacgacatagccgcgaatggcaaacttgtaatatttagttgcgtagcttttgccatcggaagcagttcgtcggaatttccgacagactgagtcttcttgtaattcttggctttgaaatatattttgtagatgttccgtgatagtggaacggcttttatcgaacaatacggcaatagcatcctgcgtcagccaaaggctttcgtcttgatataagacttctataccttcttctttattttctatttggaaaatcaagaattcagccgtgctgttgtgtatctgcaatttcttattcatggcatgttctatggacattaattatatacaaaaataaccaaattatttcagaatcagggtaactacaccaaaatatctatgagatggagcttaggaagaaatgctttttggctctggttaaaaggggggcttatcgtatattttcatgtacgctcttgctccttatcgaatgatgctgtaaaaagtcgtacgtgtttcccgaaaaacatgtacgactttttacagaaacacgtacgtgtttttcaaaaatcacaatcgtgtttttaaggtgttgatattaaacaatttatatatttgtgccatttgtataccttattgtatattattattaccaagacggaacacgcactgcctatacaagagtgggtaatattgatattgaagggtatgcacatgacatgggattcacttcctacccaagtggatgccagcaaacattcttgtaaatgaagaaaagttcggagagtgagttcggagacactgcggataagcctaaaaatataggtagaacagcacagaagatcatcgaccttgtcatttccgacctttctatgtcagccgaagctatggcttataaaattaggtataagttcccgtgctgtagaaaaacaaatcgcaaaattgcgttctatgggtatattgtctcgtgaaggcgcagactttggtggttattggcgtattattttaagttaccattttgaggggatgagacgcagcacgctgcgtctctacaactggagacaaaattgggcgaaaaaagtaagttagcttgctttggaagtgaggtattggagtttgaaaatcaaataaaatattatacatttgcatgactggataagtcaaagcgaataattggtatcaaacaatgataaactaaaaaacatatggattatcttaggttgaaatattattaatacgtatatttgcgacaagaaaaggctttttaattaagagcctcgtgttgcgtgtgatatttgtgctgtaggacgaaaatcggctaattttcttaaatctccctatgcacgaagaaggccccgcaaccctttactggatatacgtgttatctatgctaatatagtatggatatattttgtatacagataaagggggcgtgtggctgactttattgggagttgggtcttagccgaaccttcgtctacataaatgttcagtcctcgcccttcctttattttataagaaaggaccactacttaacaaaagccatatagcgctcgtctttacgaaggacatcttttctaaaacatgtccggatcttgtaaatctaataattaatcatgtaaagtgaatggcttatggacgcttgtaatattgatgagatccagaatctctttatttactactccgcttgtttcagcaagtattttccagagttagggttttattgtaatgagagggaattccagatacatggtatcgtgcggagatatagtgacattacgggagtgtcccatgatggctcttatttcttaattgagatgcgaaaagaatacctgatctacttaccgttattggtcggttccaaattccgcattttaactaaacaaaaacaactttattcgtaatacaatcttatgcttatgccagaactcatatccatagaagaagccgcccgtattaccggtttcccgtacgaggagattgaagattgggtaaaatcccgaaagataacctctttccatacgagaaccggtacacgtatggtagatcctgagaacctacgtgatttcattgcccatatcgaacatctagggattcaaaaactatacttgcaactggtcattcaagacaaggaggaggaagccgacgagattatcgcccagtacgacgattaccttttctgcctacgatccttaaagaacatctctcccctacttaaacaaatcatcgccgaactatccacatttatagatgataagcaagatcggtatatattcacggaaataacctctggggcaaaaatactggacgtagccaaacgctgcgatatatcttacgataggatgtgctaccgatataagaacatagtactccgcttgcaggaaaacaccggattcttagccgaatataagaaaacgatcagctgtcaagacctagagatagagcgcctgcggcttgagaagcgaaacatggaatatgagctgagaacgctctataaagcagtcctcaaaagtggcttgagtctcgatgctccgaaatcgtcgttcgacatccccacggatgcggccagacggatctccctaccggtcacaagcctaaccctgtctccctacatccgtaaatgcctccaaaaattggagctggaaactatggaggacctattgcgctacgctaggaagaaagggctcgattctttgttgaagatcccgggattcggccctctcggtttagaccagttaaaatttcagctggaaaagcataagatcatgaataaggccggagactcggatctctatcaatacatcatcaatgaaccggatagctgaacacaaaaagagcctctcttcacagggaggccctttttatgtgatgccggaaataaccaataaaaacttcccgacactacggtgttaatcatcttatatgcttacataaaattagcagaaggctttggtttgcgatatactaatagtgttacattctttttgacattgcaaagatacgtcggcctataagggtgcgcaatacctatatatatgtaaaaaaggagagctcatacctattaattgttatatatcttttcatggagatcgatttttagaactaatgatcttctcgcttgtaataactaacgcttacctctgaaataatacaaaaccgtattttccaaaattaactatcaagttgtcttgcgggtcaataatggggcctattgggtgtgacgtcctgaaaatattcttccgggatacctatgagtaggtaattagggtctcattttacctacttcgggcgattgtagcaaattctcagcccctgtaattttgccaaaaattataaaacgcaatgagaacgttaacaaatttattagcgattggattactttcctttaccgctctacatgctcaagagagtaatatgagctctaccgtaaaggcatcggagatgtatgccgacggtttttctaaattccgttttggaggatatggtgagatggctgccagttatatggattatgactggaattgggtgacacctcaaggtacatcacatatgaatcgggctactgtctctatccctcgttttattttagcttttgattataagttctctcccaaatgggtactgagttccgagattgagtttgagtatggaggaacaggcgccgcacgggaagtggagtggtacgaggagaatggagaatatgagaccgagatcgagaaaggtggcgaggtcgccttggagcagttccatatctcttatctgatgaacaagcatttaaacttccgttttggacatatgatcgtaccggtaggcttgaccaacgcacatcatgaacccttgaacttttttggtgtatatcgtccggaaggagagactaccatattaccttctacttggcatgagacgggtgtggctctatttggtgatttaggaaatttcgattacgagttacaagtcgtttccggtctggacccacaaggtttccgtatggagaactgggttggcaaaggtacgcaaggcgctttcgaggaaactcaatttacgcatcctgcctttgtggctcgtgtcaactataatggagtgaagaaatttaaaggcttacgtgtgggcgcttctttttattataaccaaccctctaagaatagtagcaaaccgctgcgtaaccaaggtgagaaatatccgcttaccatcgtgacggcggacgctcaatataaaagtccgaacaataatttgatcgccagaggtaatatcgtttacggccatctgggcaacagcaacgctttgacgaaggtaaacaataactcatcttcagcttccggatatcctaattcaaccgtggcggagaccgctgtcagttatgcggctgaggttggctataatgtaggttccttctttagccggaaagcccctagaatttatcctttcgttcgctacgaatattataatccgatgcaatccgtagaaaaaggcagtaataaactggcggatagacgtcttcaaaagagcgtgattacggcaggccttaactattacgcgttgcctaatctggtcgtaaaggcggattatgcgcaccgtattgtaggtaagggtgattataatagccagaatatggtttctgtcggtatcgcttatatcggctggttcttatcaagataatagactattaacaaatatatatgtaagaatatgaaaaaagtacttttattacccatgatgttgatgggtgtggctttgagcttcacttcttgtggagacgacgatgatccgggtaaggaccccgatgttgtaacttatgactttaagaatcttcctgcggattcgggtacgaaaccaacagaagatcagatgagtgcggttgtcgctactttcgttgatgaggtagctttgcctacctataaagacatgttgacaaagatgactgcctataaaaatgcggtagacaagttcatcgcgtctggttctaagaatgatttagcggatgcctgcgacgcttggcgtgcggttcgtgtaccttgggaacaaagtgaggcattcttgttcggtgtggcggatttggcacagctcgacccgagcttggatagctggcctttggataagaacggtatagaggagattatagctacaggagaattcagcaagatttcaggagctgtagacgaagacgcggaagatggtcctcaaaatttacgtggattccatacggcggaaaagatgttattcttagacggcgagcctcgtgatctggaaacaagcccgttcgcaaagaatgaattggagtatttgaagttagtgtccgaacgtatgttatctgatactcaagacttatacaatggttggttgaaaggcttaggaacttcggatgttccttcttcttatgcggaggctatgaagaaacatgacggttctgcctattccattggtaatgtttatcaggcgattgagcttatgctgaatggaaataatggtatggccggaatctccaatgaagtaggttccgctaagataactgacccggtgaccgcatggaatggaagtaataaagacgctactgacccgaataaccccggtgtcttggctgtagagtcttggtatagctggaattccttggacgactataagaacaatatcgtaagtatcaagaacgcttatttcggcggtcgtgatttggatgaggaatccgcttccgagagtagcttgcatgcgttgactaaaatgattaatcctacgttggatagtttgatggtagttcaaattgataagacaatcgacgctatcaatgcgatcggctatcctttccgtaacaatctaggggatacggagcatatcaatacggctacagaagcttgcgctgatttaacgacaggtttgggcgttgttaagtctaagttcacgaactaatcggacaagccgatacgatgaaacgaagattacttctattattcgctttatccggtagtctgctgtgtagttgcgaatccgaggacttggaaaattggcaggttaagaaacccaatgggcaggtagcttccgagaaggagttgtccgcgggtatctcaaccattttctccaatgccccggatgcgtacgatacgcaggcaaactgggttacgggcgaattagagacgcgatttaatcgtggtgatggattgtacgacgatgctcgcggtgttgagaatgtggatggtggaggactagggccgctttatgccggatattcttgcggttcctgtcataaaagtaccgggcggacccgtccggctatagctgatggaggttccggccccggcttctcatccatgcttatttatatatcacgtaaaagtggcggctattttcaagattatggccgggtactacatgatcaagcgatatacggaacgaaaccggagggaagggttaagattactactacttcccaaaaatatacgtttcccgatggggaggaatatgagttggtcactcctcattatgagataaaagaatggtatgccgatagtatcccgatgtcggatttacggatttccgtacgtcaacccttacggcatgtcggaatggggcagatgatggcgctcgacttggatatgctaaagcagatcgccgctaaaagcaattatccggaatatggtattagtggacgtataaactatgtgacggaaaagggaaagaaacagatcggtatctctggtaataaggcgaatcatgccgacttaacggtggaattgggattctcttccgacctcggtgtaacgaacgatcgtttcccgcatgaggtaggagaaggacagggtaatatgatgggttttgccatgaccggggcgcaggtctctacggaagatatggaagatgtggatttatacctccagaccttgggggtacccgcccgtcggaatgtggatgatcctacggttcttcaaggagagcaacttttctatcaagcgaaatgtcatttatgccatgtgacttccttgaagacacgccctcgcggatctgtccttttgaataatacggaattgcctcaattaggtaatcaggtgatccatccttattcggactttttattgcatgatatgggtgttgagctaggggatgattatcccagtggcttggccaacggtaatgaatggaggactaccccgttatggggattgggattacaagaggtcgtaaacggccatacctattatttacatgatggccgtgcccggaacctgacggaggctattatgtggcatggtggggaaggagctgcgtcgcgtaccctattctctcgcatgacaaaagacgagcgggccgctctgattaaattcctacaaagtttataaataaataacgcatagaatcgaaatgaaaaaaatatataggacgttgcttgtggtgcttctatcagcaggtgttttctccgtgaaagctcaagatacaaagaaagagatggatgataaatatgtagagaacgatgtggtttcactagcgggaaagaagggcttttctttttctaccaaggccggtgattttttgtttaagccctatgcgttggtacaggcaagcgcttgctacaaccgatatgacgaccaagggctggaaagccattatgccaagagcgtagcgaactccggtttcgcgatccctaacgctattctcggttttacgggtaaggcttttggacgggttactttcaatttatcgctgaatgccgctaagagtggaggtgctttattgcaacaggcttggttcgacgtagcgatcaaggagtcgtttcgtatccgtgtcggtaagttcaagacaccgtttatgcattgctatttaagtactttgggggagacgttgtttccggtactgccttattccgcttcccaatccgtattgcttccttacgacgtgaattatgtcataccgaatatgtccacgggattcgacttgggtgtacaggtacatggtttgatccatgataaatggaattatcaagtcggtatttttaatggtacgggtatcgacgtgaatttggcgactaagacaaactgcgatgatcataaatggttgccttcgctgttatatgcgggtcgtctggcctttatgccgaagggggagatgccaacgtctcaaggctcaccggagaatctgaacgacgataagatgtctatcgccgtatctgcctcttataatgcggaggccgagttcttgaccagtagcgacacccgtgtgggcgttgagttcgcatggatcaagaaccgctggtatgtggctgccgaaggttactatatgaatatgcattttaccaagatcatgcaaaaaccggataagaatttctggggagcttacgctcaattgggctatttcatcactccgaaattgcagggtgctttgcgatatgatttctatgatcgtaacgctacggatgagggtggtttgttgaatatgcccgccgctggtttgaattattatttctttaataataatttgaagctacaggttatgtatcaatatctaggtcgtagcggtcatgctacgcagaatgaccgggatgaggacgctattggattggctcgtcactccgctacggctatgttgcagttcacgttctaatctttgggtatgaaacgatatagtcaatatataatgtatgccttattcctgttattcgggctgggttgtgatgagggtaagatttatccggatgagacggttgattccgggcgaaccgctaccgtgtcactttctttcactggcctgaaagcttggccgaaggagaatatgctctcgttatgtgcttttggcgaggataagtcgaaacctttgcaaacccagcgtatcagtaagccggcggaagacggcaaaagactaaaactccgattgaataatgtcactccggatacgaggagtatagaggtcgctgtgattagtaggggattgcggttggtttactcctattatacgtctccggtggatgattcggacgaaccgcttgatttgtctgtcggcgaattggatttagcgagcttcaaacgtatacaagcgcaggtgttcgacttgaattgcttgtcatgtcatggaggaggatcgggattggccggtcagctggatcttagggacgatgtggcttataaatctttagtgaacgtaaaggcgcccctttcggaagagggtaagaactacgtgaccccgggtaatataaacaatagtttcttgctggatatattggagaataatccggtacataaggatatgttcaatagttccgggaaacaggaggtccttgctttgatccaaggttggatcttaggaggggcattggataattgataagaaagaaaatgatgaattatacgaggaggatagatacggataaagcggtagaaatgcaaatctcttcattcacgggtaaaggtggaacaacggaatatcaggtgatggtatcgatcacggacccttgtttgtctttcgtggagcaattgcaaaaccttttgcgggtttatgtgactgtcgtgaaggaagagctatcgaatgacgctaccgccgttttccgccgttattttttaagtgacgcagctaatcagacggatagcgtgatggagtgggagtgcgagagcgccttttgcccgctctctatcgttcagcagccgcctttgaatggaacaaagatcgctatgtggacctatttgcaaacggggatgtcggtacaaacgtacgattccggtttactggaagcgtcgcataacggttataggcacctctgggggggaggtgccttcaataaggcggccaattcggaatatcagacccggcttttattgaatgactatgtgatgcaattgatggggcagcgttgtacgttggcctctcattgtgtccgtacttggttctttgtgcaaaacgtagacgtgaattacgccggtgtggtgaaagcccggaaagaagtttttatcacgcagaatcttacggagaagacgcattatattgctagcacgggtattgagggacgtcatgccgatccctcggtgttggtacagatggacagttatgcggtggatggattggagccgggacagattcagttcctttacgctcccacgcacttgaatcctacttatgaatatggagtaactttcgagcggggtacggctgttacgtatggggatcgtaaacaggtctttatctcgggtacggcgagtatcgataaccggggagagattgtctatccgggcgatatcgtaaaacaaaccgagcggatgatggaaaatatcagcgtgttgctgaaagaggcggacgctactactcgtgatattacgcaggcgatctcctatttgagagatatggctgattatgcggtggttaagaagtattttgaggcgcattacccggatttgccacatttgatagtcttggcccccgtttgccgtcccggatggttgatagagactgagtgtatagcggtcgtgccgacggagtcgtcctttaagcctttgtgaaataataataaatgtacgagatatggaagaaaaaggagtatatttggctattcaaacaccaagacaagttagaaagaagcctatgtataaaaatggaatgtaccgggaaaccgataaaatgagtgatctgatctgcgagaactatccgatggttttagtcatgagccgctttggtatagcgctcgggttcggagagaagaatatcggggaggtttgccggcagaatggggtggatgcttgtactttcctgacggtcgtgaatttcttggtcgaggaagtgaatacgcctgtcgagaatatcagcaaatgcctgtcgatcgagaacttgatccgctatttgcataatgcccatgattacttcttgaacttccgcttgccacatatccgtcgtaaattggtagacgctatatccgggtgcccggaggatgtcgcttttgtgatcacgaagtttttcgatgagtatgcggaggaggtaaataaacatatgtcttatgaggaacgtgctgttttcccttatgtccgtaatttgttggaaggaaagagagatccgaaatacaatattacgatcttccgtaagcgtcatgatcagatcgagatgaagatcacggagttgaaaaatatcctgatcaaatactatccgggagcgggtacgaatatgctgaatagtgtcttgttcgatatttttgccacggaggaagacttggcttcacatacccgtgtggaggattatttgtttgtaccggccatattggctttggaaaaacaattataagcatgaatcgatgagtacaaatctaaagattgcgatagccgaaccttctgttatcataaggagcggactggagaacctgttgaaacggttaccgggtttccgtatccagatggtggagattcattcggtggaatctcttttcgactcgcttcgtatgcacaaaccggatgtgttgatcgtgaatccggctttgcccggctatttcacgttgcaacatttgaaggaggaaagcggctgtgccgagatgaaatgtatcgctttattatattctgtctcagacagtgtgttattgcgttcttatgatgaacaaattaacatatacgatagccctgatgagatcaagcacaaattggaacggttgaacgccgaggtacttccggatgacgagccggaaggggatgacgagcaacaatcgttaagctcgagggaaaaagagatcgtagtctgcgtcgtgaagggaatgacaaaccgggagatagcggatcgtttgtttctttctacgcatacggtcatcacccaccgccgtaatatcgctcggaaacttcaaattcatagtgccagcggtcttacgatctatgcgattgtcaataagctggtcgaattaggcgacattaaacagtaatcgtatatttataagtaagttaaagggaatgtggataagcgataaaagcgccttccgcattccctttactattaatataattaaatttaatgatcatatcttattaacgcttatcgaaaactaaaacccgtttattcctgtttcttcttcaaatcattaagcttataagaaatgaagaaagcatttttacttggattagcattgttattttccttatctatgagcgcacagcatttcgcgttgaagaacaatcttctctacgacgcgactacgactccgaacttaggattcgaggtgggcttaagcaaaaaggttacattggatgtctcggcgggatataatcctttcaagttcaatgacggtaagaaactgaagcattggcttgtcatgccggaagtgcgttattggacttgcgagaaattcaacggtacgtttattggcgtgcatgcgttgggcggacagtataatatcgccgggattaaattaccctttggcatattccctaatttgaaggatcatcgttatgatggttatttgtacggtggcggacttacgttgggacatcaatggatactgaataagcgttggagtatagaagccgctatcggcgccggttatgcccgtgtacattatgataagtataattgcggggaatgtggctccaagatcgagaccaagaactcgaactattggggtgtaacgaaagcggccctttctatcatttattttatccactaaaaaacgatctagagagatatgagacatttattgagtatatgtatcgctttattgttcctcggaggtgtgagcctacaggcacagaacggtgtgcggggaactgttagtttcgagaatgtaagcgcaaggaaggacggaagccagcttatgatgaattttacgaccaatctgagtaatctgcgtttgaaatcccaagagatggtcatactgacaccggtattgcaatcggtggataaatcgcagtcttaccagtttaacccgatcgtgattaccgggcgggcacgtatgaaggcgttgaaccgtgagttgggtttcgatagttatgaatttccccaaactcctagcttgattatccgtcagacgaagaaggggccggaattgattccggtggaattgtccgtaccctatgcgggatggatgcgaaacgctaccttgatggtggatgagaataccacgggatgcgcttcttgtgaggtctcaaatgacatctatggggtgatgagccgtgtattgcctccgttagcccctcccgtttatgagcttagctatgttactcctccggtagaacctgtgaaacaacggagcgagacgcattccgcttatttaaactttgaggtaggcaagtccgtattgttacgtgatttcaaagataacgctaccgtgctgaatgaggtgaataagattgtaacggaagtccgtaacgataagaatctaagctttaccgaatttaaggttaccggatacgcttccccggaaggtggctacgattataatatgagattgtccgagagtcgtgccaaggcttttgtcgcttacatgaaagataaggagaagatggatccttccttgatgaaagtgaattggatgggtgaggattggatcggattgcgtcaagaggttacgaaatcagatttggcgaataagaaggagattctggagatcttggatattcaagatataaacaagcgcaaggctaaactacatgccttgaacggaggtcggacttataagatattattggataaatactatcctcctttaagacgtattgattataccttggcttatatcgcacgtccgttcgacgtgaacgaggccaagcaagtgatcaaaacgaaacctcaatatttaagtttgaatgagatgttcttggtagccaattcttatgataaaggtagcgatcagttcaaggaggtattcgatatcgccgttcgtctttatccgaccgacccgatcgctcaattaaatacggcggcccttgagattgagactggtgcttacgatccggccatcagtcgtttgcaaggtattaatttgccggaagcatggaataacctaggtgtcgcttatgcgatgaagaaggattatacgaccgctatgcaatatttcgatcaagctgcccaagccggcatgcaggatgccgccgcgaaccgggatgagctggccgcttggttggccgagcaataatggagatacttaccttcgaatataaaaaaagcccccgtttccggaggctttttttgtgcttataatttagctttccattcattcatcaactcggtaatggtttcccgtaccgaagtgatcttattcgctcgccaagcgttactgccggcgaaagcgtatccattctcgaaattccctttgaaggcgttgtacaaggcggtgacgatacaatacgggctgcgtgatatatcgcacgtcttgatacagttgaagggacaagctttcggttgcttgattcccgccttcactttctcaaggaaactgcaatggatggctcgtccgggcatgccgacgggacttttgatgatctctatgtccttctcctctgcctgtatataggtctgtttgaaggcttccgaggcatcgcattccgtggtggtaacgaaccgggttcctaactgaacgcctgatgctccaaggtctatcatgcgtttgatatcttcacccgtataaatgcctcctgccgcaattaccgggatctttttgtcgtatttctgctcgaaatgagagacttcctctacgacttgaggtaataattcttccaatgagaaatgctggtcttccaactggttttccttatatcccagatgtccacccgctttcgggccttctagtaccaccgcatccggaagataatcatagttattcttccatttctcgcagatgatgcgtacggcacgtgcgctggaaacgatgggaaccagcttggtgacgctatctttcttgaggaaagaaggcaagtccaaaggcagtccggcaccgctgaaaatgatgtctaccttttccgctatactggttttcaccaattcggcgaagtcggaaagagccaccattacgtttacgccgatgatacctttcgctttttcccgggccttgcggatctcttccgctaacccgagattcccagcttccgtataattgctgggtgacaatttcttatataaaagtccgagaccggctgcggagataacgccgatcccaccttcatttgcaacggccgaggctaagccggaaagagagatgcctacgcccattccaccttggatgattggaatacgagcctttaggtctccgattgttaatgtcttcattaaaaaaataaatatagtgtttcaataatcgaggcaaaggtagcacaatatcccaataaatgtgcgaaatggaccagaattatcgcgcaaatattctagtcatgtgcaatgtatggaacgaaccgattattttatgtaaattcgtccctgaataattaggcaagacgtctgtaacaggattgtaatgtatgtgaaacgggtgtgaaacaggagcgttgtaactttgcgacgcaaatatagtttttatagttaggaatgaaattaggaaaagttatagcgctcatgttagtgctgcttccattcagtatgggagcgcaggaggtggatcagtcggtggaaaaacgtatcgattccttggctacggaagtgactaccttggataaggtagtccagaagctaagcaaattcaaggtttccgcttatatccaaggacaataccaatatggacaggaggacgctaccttgaaagtgggcgataagaacgagaacttggataaagggtttaaccggatcggtatccgccgggggcgtatgaagtttgagtacaatgatgggatcggaacaggtgctgtccagatcgaggtgaatgataagggagtaagtttccgtgatctgtatatcggtatcaaggacccttggacgaagcgtagccagttgatggctggtgtgttcaaccgtcctttcggttatgaggtctgttattccacgagttctctcgaatctccggagagagcgactattatccagtatttcttcccggatgagcgtgacttgggagcgatgcttaccttacgtaccaagactaccagcccattgagtttcttgcgattggatgccggtctgtttgccggaaacagtattaaccgggagacggatagccggaaagatttcatcgggcgtctgggtgccgagaaggcgataggcgactggggaaaatggggagccggtttctcctattaccatggttttgtctacaacccgactaccgaggcgtatgagatgcgtggcaatcatttcgttaagagggatatgggagagacgggtacttatatgaagcgccagtatttaggtttggatggacagtttagttttctttcatctttaggaaagaccactctccgtgcggaaggtttaatcggtacccaacccggtatcgccgggagcagtaaaagcccgaactacagtacccgaccggagaatttgccggaaaattctttgttcaagcgtcctttccttggttacttcttttatttggtacaggatataggcgcctctcctttctccgccgtattgaaatatgacgtttacgatccgaatacgaaggtgagtggaaatgaggtaggggcggaaaatagcttcacctcaaaaaccgacttggctcaaagcacgataggtattggcggtatctataatttcaataaacatatccgtctacaagcttactacgagtttaacttcaatgagaaaagtaacctcgtgaagggctacgagaacgaccggaaggataatgtattgacagtccgtcttcaatataagttttaattcataggattgtaatatctgtttcatcccattgaaataccgaagtatttattttgtatcgtaaataaaagataaatacaaagtaatgaagaagacgattttattagctgccatggcagcgtgtttgtttgctacgaatgtgtttgcccagaagataaagggtagcgatacttgtttgcctcttacccagactgaagccgagaatttcatgaataagaacaaagccgctaagataacggtgacgggtggtggctccggcgtggggatctccgctttgatggaaggcactacggatatagcgatggcttcccgtaagatgaaattcgacgagcgcatgaagttgcaagaagccggaaagaaaacgaaagaggaggtgatcgcctacgacgctctggctgttgtcgtgcatccttccaacaaggtatccaatctgacccgggagcaattggaaggcatttttaccggcaagattaagaattggaaagaagtgggtggtgcggatatgaagatcgtggcctattcccgcgagacttcttccggaacctacgagttcttcaaggagagcgtgttgaaaaataagaactatatgaacggtatcttgagcatgccggctacaggtgccattatacaaagcgtaagccagacgaaaggagccattggctatgtaggtcttgcttatttgaataaagaagtgaagccgatccatgtatcgtatgatgccggaaaatcctacgtggagccttcgttggagaacgcgaggaataagacctatccggttgtccgtccgttgttctactactatgagacgaagaatgcctcaaaggtgcgaccgttcatcgattatgtgatgtctgccgaaggacaagcgacggtgaagaaggttggttatatcccggtaaagtaagcggagaatccggacagcgttgtatgagcacatcatacaacgctgtctaaggtgcttcgacagtactgtctaaggtgttaagacaacgctgtcttatgtgttgggataagattgtccgtccgtctcttccagaaactgatccatatacagattctcgccatcccatacgatataagagaagaattgcatccaatccccggctatgagaatacgggaggtacggcttaacatcaagtccaacatgatgtggcgatggccgaaaatgaagaagtttatatcgggatgcgtctttagatattccttggcgaaaacaaccatatattctgcgtcttccccttgatactttttagcctcttgcttttccagtccgctcttccggctgttgagcgaccagcctaaagcgaacccgaacgtccagcggggatgtattcccgcatataaccattggcagaacttgttccggaaaatagccctgatcagacggaatgccttactccggaaatctacctcatcgccatgcccgaggaagaaacgtttccccaataaatcgactgtcaaggtatcccgatggatgatggcgcctatctctttcggcaagtagtcgaacatccagatgtcatggttaccgataaagatatgtatttctatacctctgtccgctaactcggccaatttccccagaaaacgtacatggcctttcggcacgacgtatttgtattcgtaccaatagtcgaatagatctcccagaaaccaaatggcggaagcgtcttccttgatgctatccagccaacgtaccagtttcttctcgatggctaaagggtccttgtggaaacgggctcccagatgtgcgtctgaggcgaaatatattttcatagaaaacctaattccagtttagcctcctccgtcatcatgtccttgtcccattccggctcgaagacgaggtttacctctacattgttcaccccatcgaccgcttctaccttcatacggacatcttccaatatgaaatcggccgccggacagttcggggcggtgagggtcatatcgatgcgtacatttttttcctcatcgatatctaccttatatataagcccaagatcgtatacgtttacgggtatttccgggtcgtataccgtcttcagcatagcgacgatcgcttcttctgtttggagaaattcgttgttcatcttcttttgttttatacgcgaatatacattaatacttctatatactaaaccgggggaaaagagaatttgtttcaccggatcagccttccttcgtctgcatagctataatagccgctatcggacaggatgatatgatccagtatcctaatatccatcagcttcgccgccttttggatacgctcggtcaaggcatcgtcgtgcgtactggggcggaggctaccggatggatgattatggcataggattataccggaggccaagacgttgatcgccgcttttaataccaaacggatatccacggaagtctggtttactccgccctgactgatttttatcttttgtatcaccttatttaagggattggttagagcgatccagagttcctcataaggtaaatcgcatagttgggtacggaataggagataggagtctttgctgcttcggatagcatcttgaggagatgcctctgaggtttcccgccgtttccctagttccatagcggcgcagatcgtgaccgccttcgcctctccgatacctttaaagccggaagttaattctttgatggaacgtttacccaatgtattcagattgttgtttacggagtgaagtatccgttgagagagttgtacggccgtctcctcattgttgccggatccgatcagtatggcgatcaattcggcatcgcttaatacggaagcgcctttttgaagcattttctcacggggcctgtcttcttcggcccattccttgatggaaagttttcctgtcttttctttcatagtcgggaaaggtttatgatttggttaaaaaaatagttcccgcctgcttatcaagcgggaaccgtatattttgacaagacccggattactcgcggatacggcctacgtaagaaccatcagtcgtattgatctcgataacctcgccctcgttgatgaacaacggaacgcgaacttccgcaccagtctctacggttgccggtttcaaggtgttagtagcagtgtcacctttaatacccggttctgtataagtaacttttaattgaacttttgtaggcatgtcggcgaaaagaaccgtatcggtagatgcatcagaaacaacgtctacaatttctccctctttcatgaaatcaacgccgttgatcaagtttttgtcgatgatcacgtcatcgaatgtctcttggttcatgaaatgataatgctcgccttccgtataagtgaactgatacgggcgacgttctacgcgtacatcttccaacttctcaccgatattgaaacgacgctcgatctgaccgccttttacaacatctttcaatgtggtacgcatgatggtattacctttacccggttttacgtgaaggaaatcgacgcagaaatagagttttccgtccaaacggatacaagttcctttcttaatgtcttgtgaattgatcatatttattttctttatttataatgttatagagtaatccttaacgattttcgggggcaaaagtagtacattcctgctaaagtagcaaaaagttttgcgtatttatatggaaaaatagttgcaaatcaaccgaataaccggaaccaagaccgctgtcatgatacccatcaagccaattgccagtccgcttaatgctccttcgatggccccgatttgaatggccgctgctgttcctactccatgggaggaagcccctaacgccagtcctttagcgatatggctatctattcccagtaccctcatcacaatagggcccactatactgccaaagattcctaccgctacgacgatgacggcggtaagtgaaggtatgccgcccgctttctccgctatccccatagcgatcggggtggtgacggatttcggctggagcgtggcgatcaacgcttggtcggctcccatcaatttaccgatgatgattacgcttacgattccgacaatggccccgacaaatacggaagtcaagatcgaaacgacatttccctttagatattggatttgctcatataacacatagccaagggccactacggaaggccccagcataaaatggatcaaatgactgctttgctggaacgactcatattgaatgcctaggacttccagtaccacgataatcacgaagatggtcgtaagcaaaggatgcaaaagactgatatggactttcttgtaaagagccaaggaagtcaggtaggtaccaattaccaaggtaagagcgaaaatctcggaatgcgccagattatccatggtctattttcccttttccagtttttgttgcaccaacgctacgctggcgatgactaaaattgtacttactacggaagcgatcagcaggactgcccaatactcggagatgatcccgaaggaattcataagccctacaccggcaggaacgaagaataatcccatgttttgggtaagaaccgtggaaagacgtttcaccttttcaggttttactttcttgaacgcgagggctaaaaacaatagcaccatcccaattacgctacccggtatgaaaccgtcgataaagtagctgataaactctcccgtgaaatagaagaagagaatgtaaaatgcttctgttagcatagtttttctaccttttttgataaccgctacaaagataacagctatttcgtagatatgttctataacatattattttaacattgtagggacggcgtccgtccccccgtggtatcaagctaacgcggaagtaatgaacatataaatcatcataccgataatatcgttggtaatggtgataaacggcccggtcgccaaggccggatctatcttcatcttatctaaggtcatgggaactaacgtgccgaatatactggcgaacattacgacggcgaataggcttaaagatacggaggccgtaatcccccggtctcccagcatgaagaagttgtaaatgaacacgaccagactgataatgctggcattgattaacgaaactacggactcttttaggatttgcggtacgatattcccttccttcaaggtattgtttgccaagccttgtaccacgatagcggaagattgtatgcctacgtttccaccggtaccaccgatcagcgggataaatagcgccatcttcgggttagtggcgaaactgctctcgaaaccaccgaggataacggagtttcccaatcctccgatcatgccgatcagcagccaaggtaggcgggcggcggtttgggtgaatacattatccgaggtttccacgtcttgcgagataccggatgccaactggtaatcacgctcgtgttgctcgcgtacctcatccataacgtcatcgatcgtgatacgtcctaccagacgtccgatactatcgactacgggcaaggctaccaagtcgtatttctcgatcgtctccgtaacctcctcgatactgtcgctgtcgcgaacggagatcgggtcttttttcatgacatgcttgatcttggagacggatgggtgggtaatcagtttctgcaaggggagcacgcctttcaagcgctcgtcgtcgtccactacatatacataatagatctcgctcatctcctccgcttgcttgcgcatctcgtcgatacatttgggcatactccaattctcgttcaccacgatcatctcggtacccatcaaaccgccggcggtgtcctcgtcgtatttcaacaagtccacgatatcaccggcctgttctacgtcctcgatatgcgaaaggatctcctcttgggtatcctcgtccaactcacgcatcaagtcaacggcatcatccgtttccatgttatcgacgaaacgcttggcgataagctcattgggaagttccttcaataacttatgacggtcttcctcatccaactccatcaatacatccgccgctttgtcgccatccatcaatagatagagataaatggcctcttgcaagttcagttcttgataaagctcggctatatcggcaggatacagttcatgaagtacctcctgtgccttcgcgtcatctttggcctcgatgatgcttttcaggttctcgatgtaatctttcgtcagttcgatcattggactcttatattattataggacatcaccagcctgcttctccagatgcttttggctgatcaaggtcagttccacgaattgctccacggataactgttccgggcgcttgtcgaatatcggcaaggcgtaatccgggcaatctttacccaataggggtttcatggaattacgaagcgtttttcttcgttggttgaatgaggtctttactacggtcttgaataacttctcgtcgcatcccagctccttgcggtcgttacgagtcattttcaatacggcgcttttcacctttggaggcggatcgaatactttctcactgacagtaaagaggtattccacgtcgtaccaagcttgaagcaatacgctcaagattccgtacgtcttgctaccgggacctgccgctaggcgttccgctacctctttttgtaacatccccgagcagcagggaatctggtccttataatcgaggactttgaagaatatctggctggagatattatagggataattaccgatcacacaaaactgccccggaaatagcttcgagagatccaatttcaggaaatcctcggcgatgatacgtcctttcagatcggggaaattctggttcaggtaatctacggattccatgtccaactcgacaacggtcaaatcatgtcccgcctccagcaagaactgggtaaggactcccattcccggtccgatttccaagaccggcaaggatttgaaagtatcgagtgtgtccgcaatgcgctgtgctatttgcagatcctttaggaaatgttgccctaatgctttttttggcttaactaatctcatccacttttcggtgtaatgtgtttgtttttaaatattatgcttatctttgcggatgcacaaaagtacaataaataatttaaagttccctatacctaatggattttaagagcattctacgtacgtttctgaagataattctacctttagccttcggctgtttactcctttggtttttgtatcggaaaatggatatcactgagatttggcgagtagtcaaggagggggttcgttatgatattattctggtttctttactgttcggcttgttcgccaatatcgtccgtggtttacggtggggattgctgatcagttccttgggcgagcgcttcaagatgagtaacgtgatttacgccgtgctgggtaattacgcagtgaatctggtgttgccccgtgtcggcgaggtatggcgttgcggcatgatcacgaaatacgataagatctcgtttaccaagctgttaggtacgctgttgatcgaccgtgtgagcgatacgatcatggtcggtttgataaccttgatgatattcatatttaatataagcttctttacgagtttcttcgctaagaacccggctttgctcgaagggttccaatccatgtttaattcgatatggatttacgtggcggtgataatttttgtcgctgtaatttggtttgtattcacttatatgagtaactttacgctggtacagaaagccaaaggcatgttgaagaatgtatggaccggtatgaagagtatctggtacatggagcataagatgcgtttcgtgatagagacgttattgatttggggaggttatttttgttacttttatattacgttctatgctttcgactttaccaaggacttgggtatcgtggtcgggctgatcacgtttacgatgagtagtatcggcgtggcggtgcctgttcaaggtggtatcggaccatggcatttcatggtgatcgctaccttggtttgttttggcgtgaacgagaatgacgcggcggcgttcgccttggtcgttcatacggtacagacggtatggacgggattgtgcggattattcggagtggtagctttaccgctcaccaatcgggagaacaaggaggctccggtcgctgtttcgtgatgaatacaagatatgtattaaatatgaactgaactaaattattaacatctatgtcagcagaaatcaaagatctatctccgaagcatgtatggggttatttttatgaccttacgcaaatcccccgtccgaccggacatatggaggcagtaacccgttttatgatatcctttggtaaaggattgggattggaaaccctgcaagatgaggtgggtaacgtattgatccgtaagccggctacgcccggaatggaaggtcgtaagaccgtgacattgcagtctcatctggatatggttccccaaaaaaactcttccgtaaagcatgatttcgagaaagatccgatcgacgcttacatagacggtgattgggtgacggcccgtgagacgactttgggggcggacaatggcatgggcgccgctctggcgatggccgtgttggcggacaatagcttgcgtcacggacctatcgaggccctgtttacgattgatgaggaacagggaatggacggcgctttcggcttgaagccgcatttcttaaagggtgatattttattgaattgtgattccgagaaggaaggggagttgttcgtaggttgcgcgggtggcgctaacgtgaatgtctctttccaatttaaggaggatacttatattccggaaggtgacgtggctgtcaaggttagcttggctggcttgaaaggtggtcattccggtgtggatattcatttagggcgtgcgaatgcgaataagttgatcttccgtttcttgaaagaggcggtatgcgattatggcgctcgtttgtcttctgtggcgggtggttccttgcctaacgcaatccctcgtgaggcttttgccgtgataacgattccgggtgataacgtggagtctctttgggagctagtggctgattaccaagatatgttccgtacggagtatatgggtgtggaggataagatcgatttcgttgcggagatggttgaattgccgtctacgttgattccggaggagatacaggatgatttgatcaatgcgatcgagggttgccagaatggtgtgattagcatgttgcatgatttcccgggtacggttgagtcttcctctaacttggcgatcgtgaagacatctgatgagttgatcgaggtgaaaatcttggtgcgtagctcatccgagtctcgcagggattctgtttgctcaagtctggaaagtgtattcgctttggcaggggctaaggtggaggagtccggtcattataatggctggcagcctaatatcaattccccgatcttgaacttgatgaaatctacctatctggatttatttggtaaggaacctgaggtgaaggtgatgcatgccggattggaatgcggtatcatccaaggcgcttatccggatatggatatggtttctatcggaccggatttggaatatccgcactcaccggatgagcgagtgaatattcattccgtacagaagatctgggagtttattacagctacattggagagaatctaaggaactctttccttatagatagtagacaagccctccagcctttgttcttctaaccattcggttagcgagaatagggctggagggcttattttataatttctctatatcctcaagggagagtccggtgcatttttggatgatgagaggtgcgattccctcggctttcatgttacgggccgtagattctttccctttcaatatccctttctcctccgcgtaatcgatcgtattcttataatccctgtatcgtttcagagcctcgtcgtattgtatgcgctcctctttgctgaggtttgccacgtcggctacttccagcaacttgtcgaagaccgcctttctcgccttgaacggcattctctctaaagtgtccatatgcttcaataaataaatccaacgttcaaaatcgttctcgcactcgtccggttctttttggaagtagggcagctcgaggtagacttgccgtatcctgtcgctgaacatccttccggtttccctgtccgccaatataacatcggtccggaactttgagttcacgtccatcttgtagttaagtaggaataccccgtatacgggttgcaacgcgaatttccagtccttccctctttgcccttggttactgatggccctcgccagatagtacagtcccctgtcgtggaaatagggttgtgccccggtttgcatctcaacgacgaataggtttccgttgctatccttgcaatgcacgtcaaaaacgattcccctgtcatccagcgtctcgggggtctgaatcgggttaaggaacgtgatatcctcaatgtcgtgctctccgaagaacaactggttcaggaaatcgattagtaactccttgtgtacctcctgcccgaatatccggtgaaagccgaaatcggtgaagggattgataaattttcccatagtgtttataggttttagtgattaatatgaaagggatggttctttttccatctcttgcggtaaagatacgctttttatttttaacacgtacgtctttttgaaaaaacatgtacgtgtttccggaaaaagacgtacgtgttttttgaaggtcataatgttgccgtaatatctaggatcttgaaggaatctcatgtcgtgaaaacggttgttatcttgactttttgtttgatataaggcttaaatcgtggcaatccctttttgccggtattgtgaaatagggggaagggggagacgataatcggggttttatataaaaaagtacggccttttacgcacgatatacgacaaaagcctgcacatatagtcgcgttgggtaacgcctatactgccgttgggcattataaacagtcacgaatagggttggcggtagtcgtgaatgggtattgtaaccctgttagaacccagtcgtaaccctatgggatagcccgaagaagtcaatagatatgaattacgatgaatgaatttcgctagaacggaaggcggttttttagcatctgcctgttaattagttgattgctatttttttcttacttatttgggaacgagctgtacctttgttcgaaaaaatcgattctccgggagttaagaatacaaaatgtcaacgtgttacttttggatagatatataaatgtacgtatgtacattattataaaggcgtaaagtttgtatgattcataaatactattatcgtgtagaaacgactagtttaaacgatcgattcttttagtcatttgcaaaggtacgcgtttcttcgacttctgcaacccttccgggctatttttttcaccccttatcctctttcttatcaatcaaataggctatccgttacgaaataaccgattccgtaaacgaacctctcttttcctccctcaaaaaacgactaatctagacgatcgtttagactagtcgtttttatgtggtttggggatcggtttaatagagctaagtatttgattatcttaataaacactagtattaatattaatttcagtattatgaacaaaaagttttctactttggctgctgtcttcttggcagtaagtgcgctttccacaagtgcggtagcgaatgtgacgaacggtaattattatcgtttgaaatatagcacgactaccccaacttcaaccgaaaaatatttgggtgtggatatagcgaagacggatagtgtcgtgctgaattccaaggcgactggctcaacagtctctgcgggaacggatactccggataatttgttgagtgatcgttatttctggaaagtcaacaagactattgcggctagcggtgattcattgtttacatttacgaacagaaaaacaggaaaggtattggctttcgacgctaaggaagcgaatgctatcatttctggtggtgccgtaaatacttggggatggaaggggcattcttcttcggcttctggaatttattccgtatctgggggtaatacttattatctcgtagaggagagtggcgttgtaaaagtaaagaaacagacaggagttacccctcccacaagtggtatgcttgcgctagaggaagacgtacctgcggcagcgaatatgtctgccaagcagttgaatgagaaaaatggaggtaaaggttttgagctagcgttctctccggctgcaaatggtgagaaaaatctcttcatagaatctatgttaagagcggaagctttacatgatggaagtacgactggtactttcgaattagattctgatgcggatcatgctcctgttgtaagttctcctgcggttttagctggtgacacagctttcttcgctgttagtggcaaggttattgagaatgcggcaaaacaaaaggtacaatattacttggtggctgatactacttattttacaggattgggtacgacaggtgttgtgtttactcaagatacgttgaaaataacgaaagatgccgccggaaagattactaaagtggagcccgctccaggacgtgtacttaacgcttatcgctttgtgacctcgtataattatgataaagcctccatgaatattgaggtggttggtttacaggcaaagaagacaagcggatattacaaggatgatgtgcaagagaaatctcttgcatctggtaagtcttggtatgtatatgtggcagaattgtctgatcggaaagaggtttctgttatagaaaatgcgacagctccttctacaaagatcacgtttaagactggctccgcaatctctgatctgaatacgaaagtagcttacgccgtccagaaagtgaaggatgatggttctttgagtaagtattatggtgctaataatgcatctactaataaggatagcctggatgtcgcttctgccttagttcctgctacacagtatatcatgattcatgaaggtgagaacaactattctttgtataacagagcgtatggtaataagcttgaggaggcttctggcgcttactataagaccgataaagaaggtatctatcgtatcaatggtacggattataagttgacagctcttactaccgcagctggtgaagccggcaagtatgttggttatagacatttctctgattcagaggtagcgaacacatcgtttactttgcgtgttcaatctatcgctggcaatagcatcttcattgcatccaaggattcctctattttcgccgctaatagcgatggacagttctttacggtgaaaccttatgactctgagaagtttggttatacatcgaaagattccttgagccgcacggcttatatgttggttgaacgctatggtgacagacatctggcctatgataaagcgaataagtttgtcttgtctaaagaggcttataatacgcagaatgacacggtggtcgtattcttccaggctaccgccactgaaggtcagtatttgttggcttatgctcaaacagatgagacaaagggtaagttggcatccacttctatggacggtaactatattatcgcgaacattactacgggtgctatcgagaaatctgcttctacagcggtagctcctaccgtattcgtattcgagaatgagaagaatgagtaccaagcagaggcggcaggtcataagatcattactttggcttccgatgacgctatgtctatcactcgtacggatgacaatttcgcttccttgaaacgtgtcggtcaattgagatccgctttcgaggccgagaacttcgctttgtgggttgataccgcagatgctacggacgagacgaaaccattgtattttatctctactaagcagggtttggattctgctacggtaaaggccggcaatagcttgtatatggtaagcgtagaggattctacggctaacgcttataagtgggaaggtctttctcgcgtagcgtttatcgagggtaagtatgtggcaggcactgattccttggaattatataccgctacggatacggctaaatatgtgaagaagcatgataacgaggctaattgggcattcgctttgaacccggatggtggcgtgtctttgcagaacatgaagtcaaatcaatatgtagctactcgtaacgacgtattggtgatggttaagaagatggatgaagccgccatgtttggtgttgctaaatctgaggtaatcccgacctcaaatggcactatcgacgctgttgagggtgtgtctgtgacaactgataacggtaccgtaactatccaaggtgccgcaggtaaatcagtagttatctctaacatcttaggtaaggtagtcgctgagacagttcttacatctgataacgtaactatcgccgtacctgccggtatcgtagccgtagcagttgaaggtgagaccgctgttaaggtggtagttaaataataaagatatataattctaagattcccgtgcggagattcgtcttcaagtaaaccgtgaggtagaacatgcggggatattaatactaaagtaaaaaattaaagctctccgtcagtatttccgtgaggcaagaaagcggaaaaagaataagccccggtcggtttctcgatcggggctttttgtctattctttgtcgtttttatctttaagtctcaatccggttctagcgttgaggggagagattaccgagtggcctaaatcgctttcaagttgtttgcgggcggcctctgctgcttttcctccttgtttggcgataacttcgtgttcttcgagatgttgcggattcttttctttggcagttttaccggcccacgtttgatagatgatatctgtaagggtagcaaactgaacgccctcttgtagtccgtgtcgtttccattcatcggttaggtctttacgtatctcgatgcttttaaggcgttgattaatccaattatccgagtaccccaacgctttatattccctcatggctcgatctatcgttaactcggggtcttgcatttcatccaatcgctcttttgccacttgggccatccatagcttgaaaggttctgctttaggggatgggatggattggataagccggaacagctgttctgtcgtagctacgtcggttttgtagtatttcccatcggtagaaggtaatttcagttggttacaatttgtaaccgactcatttccctcttttcttagcctatgtttcaacaccttccagtaattgctaggattaggactatctgttaggatagcgacaacgctaggatcgtcatacttgccggtatcgaagccgtgattgttgaatgtgagaccactgttaaggtggtagttaaatacagtttctcgatcggggcttttttggtgaatctttttaattttgtacttttgtaagcttgcacgaatgttatacatgaataggagaattagacaatggccagcgatgatataaaacaggcatggaaagtgccggaacctacgttaaggaggttgccgtggtatcttgcgttcgtaaagttgatgaaagggaaaggggaagcgtttatctcatctacccagatcgctaaggagattaatgtagatcctagtcaggtcgctaaagatctctcttttgtgaatatctccgggaagacgagagtgggatacgatattaacgcgttggttgacgtattggaggatttcctcggttttacatcccagcataaggcatttctgtttggggtagggagtctgggcgcttctttgttgcatgacaccggactgagccaatatggtttggagatcgtggcgggctttgatgtccgtgaggatttggacgggagcatgatcaatggcattcccgtttttcatatggatgattttcctgccaagcagaaagaatatggcgcgacgatcggggtgatcaccgtgccggtggagaaagcgcaggaggtgacagaccggattatcgagggaggaatcaaggctctttggaattttacccccttccgtatacgggtgccggaacatatcgtagtccagaatacttctatgtatgcgcatttagctgttatgtttaatcgattgaactcaatgaatcactaaaatatgaagattatcgccgttggaatgaactatgccgctcacaataaagagctgcatcattcgttagaattatcagagcctactatttttatgaagtcggactcctctttgttgaaagatgggaaaccgttttttattccggatttttcatcggaagttcattatgagacggagatcgtggtacggatagaccgtttggggaaaaatatagccgagcgtttcgctcatcgttattataatgaggttacggtcggtattgatttcacggcacgggatttgcagaataaattgcgtgcgcaagggctaccgtgggagattagtaaggcgtttgataattcggctgtgatcgggacctttattccgctggagcaagcgggggatgtaaaccggcttccgttccatctggatatcaatggctcgaaggtacaggaaggcaatacctcgaatatgctgttttcggtagataagattattgcgtacgtaagtcgcttctttacgctgaaaataggcgatttgatttataccggaacacctgctggcgtaggtcccgtgaagatcgacgatcatctggagggatatcttggcgagcggaagcttctggatttttatgtgagatgagaagattaatatatatattcattataggtttattactttgctcatatacatgggcggatggtagccgttatgcttctaaatccctgttatcggaggggaaatgggtgaagatccgggtggataagaccggaatctacaaattatcctatgcggatttgaagaatatgggtttctcggacccatcgaaagtctctgtccatggctatggaggatggcccttggatgaggatttcagtaaggaatatatcgatgatgtcccttctacaccggtttggcgtgggagtgattacctgttattctacgggaaagggccggttaaatgggagtatgactcgtcgagccagacattcgtgcatacgaataatccttattcattgtatggctattattttgtgaccgatgccactccgacgaatgatatgacttccgtggctcaagcgagtggcgcgactaatcggatcacgacttacgatgattatttggtgcatgagcaagaattagtatcgttggcgaaatcgggtagggagctgtatggggaagattttagcggagctaccccccgaaccctatcaacattctcttcaattccgggaatcacgaatgaagacgctaaggtaaccatgagctttgtatccaaagtcacttccggtacgggagtcgcttctttgagtattaatcagtctaatgttctggacgtttcgatccgctcgaatagagaggaatatgtgaaggcgctagaaggggtaagcacggcggtatggaaaggcgagaagagtgagaaaaacagtgtggtcgtgtcttataattcggcttctcataacaatgtacggttaaattacgttcggttacattttaagaggactttgcagccgtatggggcctatactttttttcgtagtatagcttctatcggaaatgtttcccggttcgtggtacagggcgcaaacgcgaataccttggtctttgatgtgacggatgctcagcgggtaagactgatggagacggaattgaatggctccgaacttactttctctattcctgccggtaccttacgggagttcgttttggtacggacggatcagagctttatctctccggaggttgtcggtgaggtggagaatcaaaacctacatgccttggagcaaaaagacatgatcatcatagcggctaaagctttccaaacgcaagcggaacggttggcggaggaacaccgggcaacagacggattgaccgtggaagtcgtggatcctcagtcgatttataatgagttctcaagcggtgcgcctgacgctaccgcttaccgccggttcatgaaaatgttctacgatcgtagcgtgtctgccggtaacgctccaaaatacctgttattgtttggcgatggtatttacgacaaccggggaatttgctcggacgtgaaaaatatagcaagggataatatgttgctgacctatcagtcgagagcgtccttgtttgaatattcaggattgttctataattctaatttctcgtatgtaacggatgattattatgggctattggataatgtatccgaggaggcacttgataagccgaacagtatttgcataggtgtaggacgtttccccgtgcggacggtaacggaggctacccaaatggtagataaggtaatcggttatatgcggaacgaggacagaggcggctggaaaaaccaaatcaccttcgtggcggatgatggtaacaatgcggatcactatacgagtagtcatgcggaacaagctgatgagctggcccggtttatagaggaaaatcatggggctttcctaacgaataaagtttatttcgatgcgtttaagcgagataatagcggaacgtatccggatgtacgtaagcggatctctgaattattgaagaaagggcaactgttgattaactatacggggcatggtaatacgaccgcttggtctgacgaatacgtgtggacacagacggatatcttacaatctacttatacgaaactacccatttgggtgacggcgacttgcgattttacccgtttcgatgacgtgaatacctcggcgggagaatctgttttcttgaatgcgaaaagtggagggatcgcattgtttacgacaacccgtgtggttgtatctagcggtaactcggcactgaataaggaactttaccgcaatctctttgagagggagagtgacggacgggcccgtaccttgggcgaggccatgatggagaccaagcggaaactgtctggtatcaataaacttaattttattttgataggtgaccctgctttgagaatctcctatccggagtataaggcgcaagtgacagccgtgaacggcaaggccatatcagatgagccttttacgtttaaggctttggagaaaataacggtggagggagagatcttagatacgaaagagggcttggctaacgattttaccggtatcctaaatgctacggtgctggatagtaaagcttcattgaccaccttgggcaataatacgaatgaaaaaggagatacggtccgcttctcttacacagattacccgaatacgatctatatcgggcaagattcggtacggcaaggaaaatttagttttacatttatggtaccgaaagatatctcttattcgaataagcagggaaaactgaatctctacgcctcggatgaggtgaacaagcatgaggcacaaggatctttcttgaattatatcgttggcggtaccgctgataatgcggaggcagatacgatcggccctgagatccggcagatttacttgaatgattctagttttgtagagggtgatcaagtgaatacgactccttattttgtcgctaggctgtgggacaagagcggtgtgaatataacaggtagtagtgtagggcatgatatcatgctgacggtcgacagtatgccttccatgagttataacttgaataattactatgcactattacccgataaagaaggggaaggacttgtccagttctccatccccgagctggagccgggaatgcatacggccgagtttaaggtgtgggatatcttaaataactccacgacctatacctttacttttgaggtggcggaagggttgaaacctaatctgatcgagatgtatgccaccccgaatccggcacgggatcaagtggaattctttctgcatcacaatcgcccggagtcgaacttaaaggtgacggttatggtttatgatatgaccggtaagttcctatggagtaccgagaagagcggttcctccgagttgtttaaggcttatatcgtaacttggaacttgacggataacggtggcaggcggttgcgcccgggagtttatctgtatcgggcggcgattagtacgaataactcgaaagaggcgacgaaagcgaataaattaatcattctcgcacaataaagtatcgggtaattagtttataataagcatgggggtatgtttattaccctctaggaatgataaatgtaaatgtgtttttagaatagaatatatggtaagagtttcaagattcagtctgttactagcggttttcagctttttgacggcatttacggctttatatgcccaaggaggcgcagacgatgttaaacataaattcgccccgattaatacggcgataccgtctttgtctatcgcgcccgacgctcgtggaggtgctatgggtgataacggtgtggctactacgccggatgtgaattcccaatactggaacccggctaagtatgcttttagctatagtaaggccggagtcgccttgtcctatacgccttggttacgtaaattggtgaatgatgtggctttagcgtatctggccggttattataaattaggcgatagcgatatgcaggcgatcggagcttctttgcgttatttctctttaggagaagtacaggaaagccgggatggaggaatgggtaatcagctcatattgaatccttatgagatggcttttgatgtaagttatagccgtaaattatcggatgtgttctctatggcggtcgccttgcgctatattcgttcggacatgggtgcctcgtcggacgcggatatggttccggataacgcttttgccgccgatatcgccggttatctggagaaatacgtgatcttagggaatagcgagtgcctgtggagctttggttttaatgtctccaatatcggtacgaaggtctcttacgacggcggaaataccaaccaattcttgcctacgatgttaaaggttggaaccggtttgctgtatccgatcgatgattataaccaaatcggtatctatgtggatttgagtaaatatttagttcctaccgaacctattcaagaaggtacgactcccgaggatgaggctgcttataaggaaaaacatgatgaatataacaatatgtccccgatcacgggtatcttcaaatcattcggtgactcgccgaatggcttcaagggcgagttagaggagattatggcctctatcggtctggagtataattacaatcagcagttctttgttcgtggcggttattactatgagaataaatatcagggaaaccgtcagtatttctcggtcggtgccggtttccgcatgagtgttttccagttggatgccgcttatctgatcagtacggtacagagtaacccgttggaccagacattgcgcttctccttgtcgttcgatatggatggaatcaagaaccttttcagataaatgggtatgaagatacgtgtaggttttggttatgacgtccacgccttggtgccggaccgggaattatggctgggcgggattaagatcgagcatacgttgggcctattgggacatagcgatgcggacgtgctgatccatgcgatctgtgacgctttattgggagcggccaatatgcgggatatcggttatcatttcccggatacggcaggtgaatataagaacattgatagcaagatattgcttcgtgacaccatgaagcttttgagagaggcgggctatgagttgggtaatatcgatgccaccgtagccgccgaacgccctaaattgaatccccatatccctctgatgaagaaaacgctggccgaggtcatgaacgtggacgaggaggatatttctatcaaggccaccaccacggagaagctgggcttcaccggacggcaggaagggatctcggcttacgctacggtgttgatacagcgcatgggatcgtaaaccaaaaagtactcccttttccttcttccgactctacgccgatcttcccgtgaagattatctaggatcgtttggcaaatggatagcccgagtccggttccttggataaaggaatcgaatttggcgaaacgctcgaatacgtgcgggaggttcttccgctcaataccttttccggtatcttttacgtaaaagtataatccatcttccctctccttgtatcccatgcggatagacccttggaacgtgaacttacaggcgtttgtgaggaagttggtgatcacttgggtcaagcgattcttctcggaatagataacacaatcctgttcgggtatctcgcaatagagagtgacaccgtctttcacccggctttggaaggtctggtataagctccggaatagcgtggatacgttgaactcggaatagatgaaatccatttgcccggcctcgatcttcgataggtccaggatatcgttcacgagttgaaggagaagctcgttgttcgtctcgatgatctcgcaaaattcttttgtctcctcggaggggtttgtttgggcgagcaggttcgagaaccctacgatagcgttcagcggggtacgtatctcgtggctcatgttcgctaggaaggcggatttcaaccggttggattcctctatcttctccttgtccctcagttcttgttccatttttttccgttggttgatgagggtagtacctccggttaagtaggcgggttttccttccggatcggttttccctacgatcgcaaagatctctatccatgtatattcaagccctgtatcgtctaaataacggatctcctcgtcgatcgatatgctctcgccggcgattagtttattgatcgcgtcttgcatctgttccaagtcctcggggtgaatgccgctataaaactcgtccgccgacatgcagaattggccgtcggttcccttgtcgcgaatggatctttgggtcaggtaaatattgttacattcgagccgtgcttcttttacgtcccatatccatgtcatcatgttgctggctttcaagacgagctggtatttctggttcaggtcttgcgcttggcgtgcgatttgcagctccttgtctttggccttttgcttttggatgaagaggcggacccgtaagatcccgatcgttatcaataacgccagaatgacgagtaggcttatgatatggatcttgtatttctgtaagaaaccgggaggctcttggaaatacgtggcgttcgggggatataggccgggatcgatctggtgaagcaatagatgctggtaatttaggtaggccctcggggtttccgcggtctggatcgggatttccttactatctttccccgagaggatcatttcgatcgtgttgaccgtcacctgcgcataatcctccggagaaacataatatcccccggcgaaattcccgttttctgtttgtacgtcttgcaaggtaaagattggggggacggagaaactattggtcattttctggacgttatcgactaggtaacgattctcgttatccttccgggtcctgtaccatgagtaataaaggactccggtcttattgtcgaaagaggccagtctgtccaataagttctcggtggaaatggaggtggtagacagtggctcgaattggatgcccggaaaatctttccgtagcacggcctctacatccgctttcgtttgctggcttatataacggcggtcaaaaataaaggccagtttggttaattccggttgtagctttttgattagctcgatcgtttgcttgatatagactgggtattttataaaagtggcgttatagtcttttactacgtccgtgatgggaaccagcgtatcgagcacgtttttatctaggtctatcaggtactcttctttcgggtacatataatctctggcgtagcagatgatagagggaatatctttccattccttgtcaaacaacgggcgggcgacaagccaagagggatctcctatgcatacgactaaggtgggtggcacgggaactctctctaggatcattgttctcttctcttgaaacccttccatagtgcggataccggggatctgtaagggaatcgcctttacggtaaacccttcctccccgaattttctttctatatcaagataggtctgttttgtccagctttcctcgaagttgatggagtgcagtacgactatagacggtttctcgccggagcctcgtgcgctcatgttcaagtggaccgttagtataataaaaataaaaagaatgatatttctcatggccgttaattctaagcgatatatgtagcaaacgtgattctggtagcaaatgtagtgattccgctttattaagcaagaggtttgcctgaaaataaaggttttatatgtagtaaaatggtaatagttccatcttgataggatagccttttcgcccttgtttgcctattcggagattaatacgtagctttgagccaataaagtggtatttttatgaagaataatgattggaaagatcgattaggcgtgatgtactccacgaatcccgattttcaatataatacgggagatacggaagaggaagatacgttgccgaaggagaaacaagctttgcgcatatccttggataagcggaaccggggagggaagatggttaccttgatcaccgggttccggggcacttccgaggatctgaccgccttggggaaactcttgaaagtgaaatgcggcgtaggcggttccgctaaggacggggagataatcatccaaggtgacctgcgtgccaaggtgttggatatcctccggaaagagggctattcgaaaagccgtacgatctaatccccgatcgctatgctaacaatctatagggcttccgccggggcgggcaagacgcataagctgacaggggagtacctgatgttgctcttctcccagccgggcgcttatcgccggatcttggccgtgacgtttacgaataaggcgacggatgagatgaaaacccgtatcgttcaagaactttatcacctcgcttccggccgtgcgtccgattatatccagctactctcttccgcctattccttgacggagcggcaggtgagggagcaggcccggaagattctggtcgctatcctgcacgattactccgcttttaatatcagtacgatcgaccgctttttccagcaaacgatgcgtgcctttacccgcgagatcggcttgcaaggcggttatggcatcgagatggaccaagaactggtcttgaccgaggcgatcgataacctgctggccgatctggagaagccggagagcaaagatttgctaggttggctgctgcgtttcgccgagaacaagatcgaggatggaggcggctggagtttgcggcaagacatcatgtcgctcagccgggaggtctttaaggagagttataaggcatttagcgaggaagtaggtaaggatatcgcggataagcaggcgctcgatgcctataagaatgagctatacgccattatccgctccgtagaggcggaggcgaaacgtttaggtgaggagggagtggcgttgctgaaacagttcgccttacaaccctcggattttaagggaggaagtcgttccccgtttttctatttcgagaagctggcgaaaggtgagatgaaagagccgacagccacgttccaagctttgccggataatccggatgcctatacgaccaagacgactccaccgggtctccggcagatcatcgggtgtgtatatgaggaagggttgaatgcctgcgtaaagaatatcgtatccctgttcgccaacctgacggcctataacacggcccgggagatcgtacgttattattatacgttagggatcttaaccgatatctcccggcaaatcgccttttaccgggaagaaaagaatgtcatgctgatcgccgatacgaccgagttgctgaataaggtcatcagcggcagtgacgccccctttatctacgagaagacgggtacgcacgtagatcattatatgatcgatgagttccaagataccagcggcatgcagtggaataacttccgccccttggtggaggagagtctggcgaatggccgggcgaatctgatcgttggcgacgtgaaacaaagtatttatcgtttccgtaactcggattggaagctattggacgagcaagtccgcagggatttcgaggacgagcaagtccgtgaggataccctaaaggataattggcgaagctgccgccatatcgtggagtttaataatgcgttcttcaccgccgctccggcgatcctgcaggatctatataatgaggcgttgaaaaactcctcattaagcgaggaagagcgcacggccttttccgcgaggatcatggcggcctacgacgatagttcccagcgtgtccccccgcccttccagaagaaggatggacatgtacggatcgatttcctctccggtgatgaggataaggactggaaacaggaggcgatggagcgattgcccgctaccttggagcgcttgcaggatagcggttacgcgctaaaagatatcgccatactcgtgcgtaccaatcaagaaggtgctttagtggctgatacgttgcttgcctataaggaagagcatccgtccgaccgatacaattacgatatcatctccgatgatgccctgttcgtgggtagttctccggcggtccgtttcctgatcgccgtattgcgctatttgcgaaatccggaggaccggacgaacaggaaattggcgatgtatgcctatcaagtattaaccggaaaatttggggagagcgaggcggacgagtctgtttttcaaaaccttcagtctatctcccggcaatccttgtacgaggtaaccgaagggctcttccgtaacttctccgcttacttcccggaaacggaacaggtattcgtgcaagcctttttggatatggtttccgagtacgcccaaaaagaaagcgcggatttgaaccgtttcttgagatggtgggacgagaccggttatcgaaagacgatcgctaccccggatgggcaaaacgctatccgcatcttgaccgtacataaatccaagggcttaggttttaaggtcgttatcattcctttcggggactgggagatcgaccataagccgacaaagcccgttatcctttggtgccacccggagaagaagccgtttgaccgcctgcacttagttcctgtccgttacggacagatcctgagtagcacgattttcgccaaggattatttcaaggagcgcttgcatgctttcatcgataacttgaacaccttatacgtcgcttttacccgttcgaaagaagaactgatcgtattctccccccgtccgaggaagatcaacaaggaaggtaaggttgagaagataacttccatcgccgatctattgtgggcgggggtggagacggatatcgaggatgatacctttgaaaggggcgaatggtggcatccagcttcgggtagaacggcagaagataccctggaggaaatccccatgagccgcctgtattccgtttccccggatgatcgtttacaattacgcctgcatgggaaaggattctttttcgataatgccaggcggaagcacggtaccttgatgcatgaggtattgagccggatacgtacgccgaaagatattcccgcttcggtcgaaagttatcggttagccggggtgattaaccgggaggaagcggcggagttgatcagccgtctggaagaattattgcaagcggaggaggtaaaggcttggtatgatggttccgcccgtgtcttgaatgaagtggatatcctgttcggtaaaggcttgtctaaacgcccggaccgggtgataataaaaggaggtaaggttattgtcgtggattataaatttggcgaacggcaagataagcgccatcctaatcaggtaagaaattacctgcaattaatccgtaaaatgggtttcgagcgggtcgatggatacctttggtacgtagagttaggtaaaatagaggcagtgaataagtgatatatttttgatattcggtaaaaatgaatatttttgcagattcttagtataaaacgatacagtcaaagaagaatgaaagtacataaagaaggaaccggtttactgcttacgttgtttacaatattatttattgtgaatataactttgtaccatacggtaggtaagggtatgctgttttattctgtcgcttttgtttctaccgtattgttcctattggtattaaacttcttccgtagtcctttccgccggtttccttatgattcggaaggcttggtgatcgctcccgccgacggtacgatcgttgccatcgaggaagtgatggagaacgagatccttcataagaagtgcctacagatatctatctttatgtctatcttcaacgtgcatgctaattggtttcccgtaaacggtaccgttaagcatgtttcccaccagaacgggcgttttatggcggcttatctgccgaagagtagtacggagaacgaacgttcggcggtcgtgattaccacgaggaacggggtggatgtcttggctcgtcagattgccggggcgatggcacgccgcatcgttacgtatgccaagccgggagagaaatgtcatgtggacgagcaaatggggtttattaaattcggttctcgcgtggatgtctacctgccggtaggaacagaggtgttaatagagatggatcaaaaagtaacaggcaatcaaacgcctatagcccgtttgtcaaaatgagtataagaaaacatattcctaatacaattacgtgtctaagccttctgtccggttgtgtcgccagtgttatggccttgcacggaaatcttttatctgcgttgatttggattattatagccgcggtctttgatttctgcgatggctttgccgctcgtttattgaaggcttactcgccgatgggaaaggaattggattccttgtcggatatggtaagtttcggcttcgctccgggcatggtggtctattggttgttgggagaggcttctacggctttgccttttggctctttgaatacgtatatcccttatctggcgttcgtgatccctacgttttcaggtttgcgtttggctaagttcaatattgatgaacggcaaactacctcgtttatcggcttgccggttccggcgcatgctttattttgggcttcggtgggatattctgttttaccggttatccatgcgaatgaaggcttgttcgtgttggtgactgttatcttggcgtttattacctccttgctgttggtgtctgagataccgatgttctcgctgaaggtgaaatccttagcgtggaagggtaatgagcttcgctatatattgatcgcttgtgccattattttcgtggcgttatggggattcttgggaatctctggaaccatcctgttatatatagtcttgtctatttttaacaaaaagggataaacaagaattcttatctttgtgtttgtgatagtaaagaatcatttaagtatcggattatgtttaagtttttgtttgtaatattctttttctttatcctgttggtgtttctgatgggtttctccatcttgcgtacctttaagaacatcttttttggtagcggaaacagcactcgtaagggagaacaacgtcgtcaaacaaatagcaatacttccggacatcgttctacgactactaccgcccgggacgatgatgatgatcgtacaccttatgtgcaccgtaagaagatattcgccaaggatgaaggggagtatgtggattacgaggaagttaaatagagcttagcgtctttgcttaaagaaacgctgcatttcttccgcgcactctttttcaaggataccttttttgataatcgctttcggatggaaggcttgaggggcgaatttggagaaacctcttttatcatcggatgccccgtatacgatcgtgcttaattgtgcccatccgatcgcgccggcacacattatgcagggttccacggttacgtatagactacaatttgtcaggtatttcgctcctaagactccggcggcggccgtaatcgccaacatctcggcatgtgcggtcacgtcgttcaagcattcggtttgattatgcgccctcgctatgatctggttgttgcagacgataacagctcctacgggaacctcaccctcggacgctgccgcacgagcttccaccaacgcttgcttcatgaaatattcgtcattgaaaggattcatcttctcatctcattttcgttgaaaagagtcggataatcctcctccaaggtcttgaggatgtgagaaaggatcgtctctcggtaccaacgggacttattctcgatcttgtagcgtgaaaggtaacgttttaccgctttatgctcttcgtcattcagcataaaggtcactttgtgtaccctcggatgattggggtgagccgatgaatatttacgttcttctttcatacatttgcaaatgtacgagtgaatagccgaataacaaagaaaatggctatatttgtgcaaattaatgcgatggcaagacagaacgatatgggtcgggaaggtgagtctgaggctcgtgcctatctggtaaaacatggatataacgtgttgcataccaattggcattggcatcattatgaactggatattatcgctgtcaaggaagatgagttaatcgtggtggaggtaaagacacgctctgaggattttttgctttcaccggaagatgcggtagacaccaagaagattcggaggattgtcgccgcagcggatgcctatgtccgttattttaatatagacttaccggtccgttttgatatcgtgacattgatcaagaaagagacggggttcctgatcgaccatatcgaagatgctttctatgctccttgctgttaaaagataaacgttatgaatatagaagaagtacgtgaatactgcctttccttgaagaataccatcgagtgtttcccgttcgatgaggtatcgttggtctttaaggtagagaataagatgttcctgctgcttcctttggatgcggaggagcctcatgtctccttgaaatgtagtacggattatgtggaagagttacgggaacattatacggcggttgagccagcttaccattttaataagaaatactggaatagcatttatctggaccgggatatggaagacgaggagattaaacgctggatcttccattcttaccgggaagtgatcgctaaactaccaaaaaatataagggaaatttataatgatgagcactgataatgaatctccccgcatcttgcgtgtggcggaaaccgcttctacgaatagcttgcttcgtgagttggtcatcaaggaatctcttgcggaaggaagtgtggtcgttgccgatttccagacagccggacgtggtcagatcgggaatacttgggagtctgaggcgggaaagaacttgatgtttagcttagtcctgtaccctacgtgcatccctgcgaaccgtcagttcttgatttctcaaatagcagctctaagcgtgaaggaggcgttggacttatatgcggatcatatcaccgtgaagtggccgaacgatatttactggaaagacaagaagatttgcggaatgttgattgagaacgacctgtcggggcataatctgtattgctccatcatcgggatcggcataaacttgaatcaaacggtatttcgaggagatgctccgaatcctgtatctttgtttcaaataatcggtaaggaagtagatcgggaagaggttttgcaccgtttcctctcaatattctatcgctattatttatctcttctccaagaggaacacgaggatattcgagctcgttatcaatccgctttgtatagaagagaggggtatcatggttataaggatgagtccggcgagttcgaggcctgtatccatgatatagaatcaaccgggcatcttttgctagcattacgggatggaagcattcgccgttatgcttttaaggaagtctcttattgcaaatgactttttgatcggagtgattttttactacgtatttttataatgtacacgtacattataaaatgtgtgtaatagtgtatatctgttggaggaatgaaccgaagataagtattgtggtattggataagagatggtttgtctttataattggcggtttcgtaatgaatagcctatttgattgataagaaagcgtatatggtaacaaaaaaataatagggaagatttgcacgaatcaaagaaacgcgtacctttgcaatgatgaataaaaccgattgccctaagtccgtttaaaaggcaggcaatccaatagaagagcttattacactttagtattaatattaaattatttaattatgaacaaaaagttttctacgcttttggctggtgctgcatttttgagtgctgtatcagttaattctgtttatgcacagggggtgcaggataacagtttgccaacagaggctagtgcttatcctatcgttaagttagcagaaggaacaaacactggtttattccaattgaaaattaaggattctgacaaagtcttatcaatggataaggatggtaagttgactttggtaaacgttactacctcttcacagttggctaacactttatggtgtgtaactgttacttcagagaatcaaggtcagactcacaagtatgatttcatgaataagggaacaggtatgatgttggatataactatgtctgatatcgtaggtgctgaagaaagtacacccgttatccctacaactggaggtgaaatttctggttgggctttctctagagaaatcaataagttggaaccggagagacctctgttctctcatttctctgccgattctattgttggtttttcagtgaaaactaacgatgacaaagtttatgtgcagaaagagggagctaagaaagctgagacagctggctttgcgaagtttacattacaagctccgggtcagatttatttgagtgccgaggagttgaatacaatcttcggtgtgcaaaaggaggatgctggtgttaaattgacatttaataaggatgtgcttggtacaactttgacgaatccgtttaacgctaacaaattcttagcagaagaatctggtgatactaaatatttgtatatttctgatttgaagaaagaagcttatttaagagttgatacagcttatacaaatgaaagcggtacaaagttcttggcttacaattggacgaagaaaggtaaaacaggcgaagctatagatgcagtgagaggcagtaaaattcaagatcaacataaatttgctttcctttattctccggcttatgatagcttatatatctatgtgcattcaatcacttggaatgagacaaaagctaattgggagacacttgtaaaaaaaccagaggcgacaggtgataactggcgtgtttctttgcaagacttgatcaagaaccaaactcgaatcttgacggttgatgctaaggagcaaaatacacatatctctttcggcaatatggattgtaatccggttgcttctacaaagacttctgttgctgatggcgtttatttaattaagagcgctaagactggtaagtatttggcaatacctttgcataacgatacaacttgggtcaacaacgtagagaaagcaaacacagcagaatgggcgtctttggacttacaagatgctaatcatatgcctgcttatcaatgggttgttttgaaaaagaatgctgttgataaaaataatatttctccgatcgatgcttggaaccgtgagtataatacagtaacattgagttctgttcagttgaacaagaatgtaggtggtaagtatttctatattactactaacgcaggaacagtgcttgctggtgattctctagagttgatcgcagtagataagaagttctattctgataagtatcttggttataagaatttgactaaggatgagttgatggttaataagtatacgttcaactattggcatccgtatgctgctgataaatatatcgcagttatgaaagattctacgatgactgtaaaagatggcaagactccgtttactatcaagactacaggtaaagagcataagtatggttatgacgcttctttagtaaatggcgaaaagggtagaatcccgggattagctcaattggtaagaactatgtatcaagtttcttacgatggtgctatctttggtagctacgcagaggctaaagagaataagtatacagtaagtaaattgcatcaaactacagactctgtttacttcaaagaaaacaactgtatcgctcgtgaagaaggtgctactgttgctcattactatgcaattgtagaggctgacgtggatggcgttatccgtaactataaagctggtgtatctgactatgacgcatctgcttctttgaaggctcagactttgaaagaaacaagaacatctgcgttctatatcgctcctgataacactccgttgtatcgtcgtttcaacaatactcttgttggagagaatgctaatgatgctgctgatagcttgtatttcgtagagtctatccgtaaggagtacttaatggatgagaacaacacgaacctgcaacattctacagtggactacgctggtatttggaacaaggataaagctaatggtaaattggcattccgtgttgatactgcatggttgaaacgtggcgcaggcgagatcaaacctcaatacttgatttctgcattccaagatgtaatcgcaggtgagaagatcattccttgtacagaggatggtaagcacatcaaacctgatggaactccgacagagaatccttacgaatgtgtacacgctgttcatgttaagactccggcattcgtttatggtaagtacttagttaacttctctgattctgcagttgcttgcaaagctgacgtaaatccgtttatcttcaatacgaaagctgtttctaacagtagctatactcgcgtaggttttgttcctgctgttcaatatggtgatacattgttagtcttgactggcaagtatgcaaacatgacgaaagagcaattgaagaacgagggtatcgaatctatgatcgctacttataagaaagaatatccttcattcatcaatgatttgagaggtgacaaacataagaatgtaacttggtcattccgttatgtaaatcctgatttagctgctatctcttatgtagatggaaaagaaggcgagaataactcattcttgattgagtctaatgtatatgataaagctcatgatactcaataccaaactgtaaatggtgatgcaactcaggctatcgctccgaaggctgctgccgcttggttgaagatgcacaatggttgcttggtattgacagatgtgaatgctacattcgacaacgctaagactggtggcgacggtgcattggtattcaacgcattccagaagactgaagaagaagatatggtaacttctaatgacgaaatcgctactgaaggcgtatccgtagtagcaggtaacggtactgtaactgttcaaggcgctgctggtaagtctgtagttatcactaacatcttaggtaaggttgttgctgagacagttcttacttcagacaacgcaactatcgctgtacctgctggtatcgtagctgtagctgttgagggtgaagaggctgttaagacgatcgttaaataagtagaaaactgatcgaatttccgtaaggaaagacacagttcataaggtagagccccgtcgatgtatttcggcggggcttttgtgtgttgtgttacgagtatttctgtcgatgaaacaaacgttattctttctttttgattgatatatgtctatatgtatgacattcctttctggtggagagtataaaatagcagaggctggatgactgtaaacggtattttttattagaaaagccccctttttgtatgcgatagatggtgaaagcttatgcgataggtcgcattgggcaactccggcaatgccgttgggcatcgtgagcagtcaagaatagggttgttgatacttgtgaatgggcatcatacccctgttatgacccagttctaatcccataaagtcccttaatcaaccccttaaatatgaattacaatggataaatttcgctagaatgaaaggctgtttttcgataagagtctgtcacgtaaatgattgctgaaattttttctcgtattagagagtgagttgtccataagtccggaaaaatcgattctccgggagttgatattacaaattgtcaaaatggtaattgcggagatcctcaaaaggggaagcttggcttgtttaaaacttcgttatcatttccaaaaaaacacctatataccagccttataaccccctatttgatttattctgcttatatttgcgagttatcaacagttagggcgatttatcaacaaaacaagcattgttttgattgaaccctgtttggttcagtttttaatgtttagttttgccctcgaattaattaggtatagtatgggaaagattatcgctttagcaaatcagaaaggtggagtcgggaagacaaccaccacgattaatctggctgcgtcattggccgctcttgagaaaaaggtgctggtcgtagacgctgatccgcaggcgaatgcctcatccggtctgggtgtggacatacgtaatgtagaactttctatctatgaatgtctggtgaacggtgaggatgcgagcggcgctatcacacagactgaagtggaaggactggatatcatcccctctcatatcgatttggtgggagcggagatcgagatgctaaacttggagaatcgtgaacggatcttgaagcagatattgacaccgctgaaagagaagtacgattttatcctgatcgactgctctccttctttgggattgataaccgtgaatgccttgacagccgccgattcggtgatcatcccggtacaatgcgagtatttcgccttggaaggtatcagtaagctgttgaacacgatcaagattatcaaatcaaagctgaacccggcactggagatagagggattcctcttgactatgtatgattcccgcctgcgtttggcgaaccagatttatgaggaagtgaaacgtccgttccgtgatttggtatttactaccgtgatccaacgaaacgtgaagttgagcgaggcttccagttacggtaaacctgtcttattgtatgacgcggattcgaaaggatctatcaaccatatgcagttggcacaggagattgttgaaaaaaataaaggattatggcagcattaaaaagatcggcgttaggccgtggattagacgcgttaattacgatggatgacctgaagacaggtggttcatcgtctattagtgagatcgagttaagcaagatccagcctaatccggagcaacctcgatccatctttgaggaagagaccttggaggagttggctacctctatccgctcgttaggcgtgatacagccgattacgttgaaggaaatcggccccgagcaatatatgatcatctctggcgaacgccgttatcgtgcgtcgctaaaagcaggtttggagcgtattcccgcttatattaagacggcggccgacgaaaacgtggtggagatggctttgatagagaatatccaacgagaggacttgaactctatcgaaatcgcgttagcttatcaaaaattaatcgataattacggcttgacccaagaggggctgagcgaaagggttggaaagaaacgtgctacgatcgctaattaccttcgtttattgaaacttcccgccgagatccaagtaggattgaaggacaagaagatcgatatgggacatgcccgggcattgatcccggtggatgatccggaggttcaattagctttatatgagcagatattggctcaaggactctccgttcgtaacgtggaggagatggtgcgtaatatagccgagggaatacaaccggaattgccggaaaagaaaaaatcggatcgtaagccgatacttccggaagagtttaaattgctgaaagatcatttgtcccgttacttcaatacgaaagtccagttgacttgcaatgagaagggaaaaggtaaaattacgattcctttcgccacggaagaagagttggagcaattgatcgggttactggataaattgaaatgagaaatcgaatcatactccttttgatcggattcatgtgctatgccgggatgggtaacgcacaggaggataagacggagaaagccgttcctgctatagtttccgattccgtggaggtagctgccccggattctaccgtgcaagccgtcttgatggcggccgattcggtgggtgtaccggaagtgaagatgaagctggcttttaagccgaatccgacaaaagcggtcttgttcgccttggtaccgggtctgggacagatctataaccggaaatattggaaattaccgatcgtttacggtggcttgatgggatgtatgtatgccgtgacttggaacaacaagaactataaggattattcgacggcttataaggatatcatgtatgatgccgctaagaatctggaaaatccggatgcttggagtaaaagttggcaagacttgacttccatggctcctgaggatgcgattaataattcaaatttcaaggatcaattgaaaagacagaaggattattttcgtcgatatagagacttgagtataattattacggtcggggtgtatgcgttgagtatcgtggatgcctacgtggatgcccagttattcgattttgatatatcaccggatttatccttgcatttggagccggttgttagtccgaagacgagtgtcacgcctcgtacttacggattgaattgcagtctaaaattctgatatacatgaaaagatacctgctagcactcatttgtttaaattgtttggtctcattggtctatgcgcaggaagagacccgaattgaggaaaaagataccttaagctcgctggagtctgaggtcggattgattccggaaagcttggatgcgaacgtggatagtttgctccgtacttggcatgtgcaatatttctcaaaaagagaggacttttgccatgatgacgacgagaatgtctatttcccggattcggtctatatcgaccgcctgtctaggcttcccagcgtgatcgctttgccctataataatatagtgcgtgattgtattgacttatatgcggagcgtaaacgaaatttagtgcgttatatgctggggatggcggacttttattttccgataatcgagcaggtgttggatgagcatgacctgcctattgaattgaaatatctcgccgtcgtggaaagtgccttgaatccggtagccctctctcgtgtgggcgcttgtggtttatggcaattcatgcttcctacgggtaagagctatggcttggagattaatagcttggtggacgagcgccgggaccccttgaaagcgaccgaggccgcttgtaagtatttcaaggatatgtacgctatctatggggattggaatttagtgttggcatcttataactgcgggccgggcaacgtgaataaagcgatccgtcgttcggggggcaagacggacttctgggatatcttcccttatttaccgaaagagactcgtttatacgtccccttatttatcgccgccaattacgtcatgaattattattgcgagcataacatctgtccgatgcaaaccagcttgccgctagccacggatacggtcatggtgaataatgccctacatttgcagcaggtatcggatctattgcaagtagatattgagacgttgcgtgcgttaaatccacaatataaaagagacatcgttccgggtaatacccgcccttcggttttgaaactacctgcggcggaaacctatgcttttatcgataaagaagatacggtctatacgcatcggatcgaggaactgttggcgaattgcatttctgcgaataactctaatggctctttaccaagtggtgcgacccgggaaaaaatcacccacgtggtattgagtggtgagaatctttatacgatcgctaatcgctatggcgtgacagcgaaagatatccgtaaatggaacgggctaggctccaaccgggtagcgaaaggaaaacggttaagattatatgtagataatgggggtgtcgcttttgcctcggctaccaagactccggtgaaatcaactaccgtgactgcgaaatcgactgcgacaacaacgaaaaagtcggcttccgtcgctacaaaacagatcgcttccgctaataaagattttgtctcttataaggttaaatcgggagattcgctttattcgatttccaagaaataccctggggttaccgcctcttccttacaaaaggtgaatgggctgtcaagtccggatatccgtccgggtcaagtactgaagataccggtaggatgatcattcggggataattcgtctttaactcttttttttcgctttcttcctgcactggagaaggatgtgaatgattttttattcctttgtatacgaaaaaagatacaatcgtatgggttcattggatgaaaagatatcagtggtcaaggctaaaccttggttggtcagtttggtttgcgcggtgtttattgcctacccgaatttggcatggatcttttgtgacatgagctatctggctccgaacgatcatcaaggatttttactcttctttgggttccgttttctttacttctggggacttatttggtttttgctgaaaagtaacttgaggcatgaggattgtacctccttcttcgagcggttgctctggaatgccctgtacgtttccggaggctttgttgtctataaattgatctccttcctgactattagttatgatcgttttttgagtatcattatcttccagtttatcgtgttggcgttgttatgtaccttgatcggctatatacaaatgctatatcacaatcaacgggaaaaggatcaattgatcgagaatctgcgtgtcgagaatttgcagagccgctgcgatgcattggtgaaccagatcaatccgcatttctttttcaattcattgaatggaatctcctccttgatacggaagaaaaacgatgagaataccttgttgtatgttacgaaattgtccgatatattccgttatatccttcagagtgataaaaagaatttggtaccactgtcggaggagcttgcgtttatagaggcttttcagcatgtaatggtagtccgtttcgccaataagcttacttttacgatcgaagttcccgaagataagcggaacttgcgaattcccgtattatctttgcttccgttggtagagaacgtgacggtacataatattatagacagcgagcaccggatggatatcttgatccggctgaacgagcgaatggaactggttgtttctaatccaatctatccgaaattgaccttaccggatacgaatggaaccgggcttaagaatctggagaatcgtttcttgctattaatgaataaacaaatacgggtagaatctgatgaggatgagtttcaggtatacctacccctaaaatgatgctatatgagaatactgatcgtagaggacgagaccgccgcctatgagaacttagcggatatgttggttacaatagatcccacgcttgagatcatgggaaatacggagagtgtccagcaaacggtacgttggctgcaagccaatccgaggccggatttgatttttatggatattcatttatcggatggttccgctttcgctatttttgaccagatagaggtggaggcaccgattatctttactacggcgtacgatcaatatgcgatcgacgctttcaaagtaaacagcatagactatatcttgaagccgattaagtcggaagaattgaaaagggccttagataagtttagccgatggaatcatcaagatatcatccattatttatcccaattaacacagttgtctactactcctaaatacaaggataaactactgattcctattaaggataaattgttgcctattagcttgaaagatgtgtcttgtttctatacggctgataagaatacatatgtttatttaaagagtggtaattcgtatccatatgctaaaacattggaacagataatttcttctttaagtcctgctgattttattcgtgcgaataaacaattcatcatttctcgtgatagcgtgaaggacataacaatttggtttgatagccgtttgctcgttactttggatgtagaagtgcctgagcgtatatatattagtaaaaataaagcatccgagtttaagtcttggatagtaagtctggaataataattaaatagaaatgccggttctcttaaagccggtatttttttgcccttttcgtgttcaatccccattttttccttttcgtcaacaatcggaaacttcctatccgataattcttcatctttgcaatacaaacaaggagatacatcaataagatgtaagttgaaattttgatgttaatccgagttttatcatacacattagataggttaataggtttgtaaaaaaggattagtccgaaacaaaagaatgtttaggctatcttctctaaaatgagtgtttgttttgtaaatggttttgtaataggtaaattgtaggtattatgagaaagttaattatggcggtagcggttttgggaatgagtgctacaatgaattttgcgaaagcgcaatgtgtgaatgaatatgggaataaagaaccgtttgcggtagagtttagccgattgagttcttatctaggattggctccttaccaaatggaggaggtacttaacattaatgattattttgtacaagaacaaagaaagagtttgagcaaagacctgaagcgtcaggatgaacgattgcaaaaagccgtgtacggcaatttgaagctgatgaaagaggcgttgacagccgatcagtatcgcaagtatgtcatattgttaaatgtaactaacaacaataaccgattaaccggagctgtgacatttacggatatctatttggctgagaataaatgagtgtaaccttggctcgatgtgatgttgattagaaaggcgatccttgtgttcgaacagggatcgccttctttgcttctgtccttttccttttggaagtgcgctatcagattttagcgaaagcttgatccagatcatctataatatcatctatatattcggttccgatgctcaagcgtacggtggatggtgttatgtgctgttgggcaagttcttccgggctcatctgggaatgagtggtcgtgtatggatgaatgacaaggctctttacatcggcgacattcgctagtagggaaaatatctccagtgagtcgatgaatttccaagcggcttcctgcccgcctttgatctcgaaggtgaagatactgccggcaccattcgggaaatatttattgtaaagttcatggtccggatgggtaggaagtgatggatgattcactttttctactttcggatgttttgataaataatccacgactttcaatgcgtttgctacatggcgctccacgcgtagggataaggtctctaatccttgcaacaatataaaagcattgaaaggagagatcgttgccccggtatcgcgaagaatgaccgcacggatacgggtgacaaaggcggcggaacctgctacgtccgcaaatatggctccatgataacttgggtctggtttggctaatgtaggaaacttatcggcattcgccttccagtcgaaagtacctccatctacaattacacctcctaggctactgccgtgtccccctatgaactttgtggcggaatggatgacaatgtcagctccatgttcgatcggacgaatcaagtagggggttccgaacgtattgtctacgattaatggaacatggtatcggtgagcgacttccgctaccgcatccagattcgttacgtcagagttaggattcccgaatgtctctacataaatggctttcgtgttttcccggatggctgcttctaatgcgtttaggtcatttacattgataatcgtattagtaatgccttgggaggccagtgtatgggtgatcaggttgaaggaaccgccatacaaattatcggccgcgataatatgatctcctgccctcactatgttctgtaacgcataggtgacagccgctgctcctgaagccacggccaaacctgccacacctccttctaaggcagctacacgtgcctcgaaaacgccttgcgtggagtttgtcaaacgtccgtaaatattccctgcgtcacgtaggccgaaacggtctgccgcatgttgtgcgttatggaatacataggaagttgtttgataaatgggtactgcacgtgcgtcggttgcgggatccggttgttcttgtcctacatgaagttgtaatgtctcgaaatgtaacttctttgttgccatagtcatcttgtttatttagttcttattctgttggcaaatgtatgatgtgtgtgctttttggacaagattcgttgagaatatagaaaataatactatttttagggctataaatagaatacatcttcggcgaaggacgctggggaatcaatccgatagaatttttttcttatgaatgtttcagataagttagacaaggtggatctgcaaatcctccgaacgttacaagataatgcccggttgactacgaaagagttggcggcaagggtcagtctctcgtcaaccccggtgttcgagcgtttaaaacgtcttgagaatagtggatatataaagaagtatatagcggtactagatgcggagaagctgaatcaaggctttgttgtcttttgtagcgtgaaattggttcggctgaataaggatatagcttttgagtttacccggattattcaagaaatccccgaggtaacggagtgctataatatttcaggcgattatgattacttattgaagatacacgctcccaatatgaaatattatcaagagtttattttaaatgtgttaggaacgatcgatagtttgggctcgttgagaagtacttttgtcatggacgaggttaaacacgactatgggatccatatttaagcagtagatattctatttttgtcttttgttagggtttccttccaaatatttgtatatatttgtggctatacagtataaaaatgggaggtgtaaaaccatggacgatacaaaggacacaaaagatataaaagaaacgggcgaggctgcgtccgttctctctgcggacgaacagatgatacaagatgggttcaatgcgttgttgaacgattatttgaagtcaaaccaccgccgtaaggtcgaacgaatcacgaaagcttttaatttcgccaatcaagcgcacgccggagtgaaacggcgttccggcgaaccttatataatgcatcctatcgccgtggctcgtatcgtatgccgggagatgggtttgggctctacctctatttgctctgcgttattgcatgatgtcgtggaagataccgagtatacggtggaggatatccgggatatgttcggagacaagatcgcccagatcgtggatggcttgacgaagatatccggtggcatttttggggaacaggcctcggctcaagccgagaacttccgtaagttgctgctgactatgagtgacgatatacgggtgattctaatcaagatcgcagaccgtcttcataatatgaggactttgggttccatgcttcccgccaagcaatttaagatcgcgggtgagactctttatctgtatgctcctctggcgcatcgtctgggtctcttctcgatcaagacggaactggaggatttgagttttaaatatgagcatccgcaagaatatgacttcatcagcgctaagttgaaagcgacagaagagagccgtaataaattattcgagcgtttcgccgcccctgtggacgagaagctgaaatcgatgggacttcagtatgagatgcgtgcccgtgtgaaatcggtctattccatttggaataagatggaaagcaagggtgtcgctttcgaggatatttatgatatttatgcggtccgcattatttttgacccgcttcccggtgtggacgagaaaaaccaatgttgggatatctactcggctattacggatatttaccggattcgtcccgaccgtatccgtgattgggtgagccgtccgaaagcgaacggttatcaagcgcttcatctgaccgttatgggaccggatggacaatgggtagagatccagatccgtagccgccgtatggatgatatcgcagagaaaggcttcgctgcccattggaaatacaaggaatccaacgtggaggaggatacggaattggataaatggatacaaaccattaccgagatcttggagagtccggacccgaatgcgctggatttcttggatacgatcaaactgaacttatttacttccgagatatttgttttcactccgaaaggagatataaagacattgccccaaggggctaccgccttggatttcgcttatgcgcttcactccgatatcggtaataaatgtattggcgctaaggtaaaccatcgtttggtgccattgagtcatccgctgtccagtggagatcaggtggaggtcttgacttcccgctctcaggagccgcaaccggagtggttgaacttcgtgactaccgctaaggctcgtgcgaagatcgatgccgtattaaagcgtgtccgtaaagaggtcgctaagtatggagagataaaagttcttgatgccttcaagcgttcggagcttgaggcgagtacatccaatctggataaattaggcatgtactttggattctcgaaacgcgaggaattcttttatgcggtagagaagggggatgtggttttgcccgagaatttaaagaagctgttgaaggagaagacggataatgtcttgtttaagtatgtgaaacaggcgttgggtgtcgcttccaagaaggtgaaacaacccgaagaggaggaagccaagaaagagaagcctaaatatgataagaaaaagccttatttattgaaagaggaggcttttgagcgtaattatgtaattgccgaatgttgtaagccgattccgggagatgactctttaggttttatcaatgacgatggaaatgtagtagttcataaacgttcctgcccgatcgccatgcgcttgaaaagtagctttggcgaacgtatcttgaatacggtttggagcagccatatgaacgcttcttttgaggccacgctagaggtgaaaggtatagactcgataggcgtactgaatacgatcacgaaaacgatttccgaggatttcaacgtgaacatcatgcgcttgctgatcgaggcgaaagacggcgtgtttgaaggtaagataaagatgaaagttcatgacgtagaagatatccagaaaatgtgcgtgactttgtcgaagatacagaatattaaatctgtcggacgtgtagcggattaagtgtagcgaagtgcttcgctacacttttgttttataaaagctttatcagccgacaatcaaataagttatataagctatataacaagcgatcaataggattccctccggcctagtgatggtccgtttcttgaagaaaaggccaaaaatataaagcaatacgcatgaaccgatcatgacgcccaaatccagattggtaatgccttgtatgttcatcggcgtgattgtcgcgctacaacctaatacgaagaatatattgaagaggttggaaccgataacatttccgatcgccatctccgggttcttctttaatgcggccacgacggaagtcgctaactcaggaagagaggttcctccggccactaaagtcaaaccgataatagattcgctgacccccagcccacgggcgataccagaagctccatccacgaaaaattgtcctccgtaaatcaaaccggccaatccaccaatgatgaataaactcgctttccaaatgggcattattttaatcgtgctctctccattttcctctccattatgcgcgatcgcgaatgtatagccaaggaaaatggcgaagaagcataatagtaacattccatcgctactactgatactattgtgcgatgcgccgttgatcaaaacgtcattcgcgcaaatgaataatacgattgaggcaagcacgcaaagagggatctctttgctcaacgtacctttcgtgacgctgatcggcacgatagcggccgtacagccgacaatcatcaaggcgttaaatatattgcttcctactacattaccaatagcgatatccgagcttcctttcaaggcggatacgacactgaccgttaattccggtgcggaagtcccaaacgccacaatagttagcccgattactaagctggaaatattgaagcgtttggctaccgaggcggcaccatccgtcaaggcgttagccccgactaaaattagtagtaaaccgccaattagtaatacgatatccattagtctttagaatggcaaatcatcgattggattggccggcccgaaatcaggagcggatgaggctggagccgtaggagcggaagccggagcgaaattatccggagttactcccatcggagcggcttgaggagctgccgccatcggacggtctactttccatgcgttgatactggtgaaccagcggccttggtactcacggctgtcaatgtcgaaagagactgtcaattcctcgcccggctgaatggccgcttgagcgatcttatccgctccgaatatctggaagcatactttcttgggatattgatcgtgtgtctctaatacgtactcttgttttttccattcgtttccggctttgctgataccgcctacttccggtaggacctgaatgatttttcctgtaatttccatgtcttgtattttatttacttatgttttatttaatgggggacgaaggtacggttttgttctgattttatcaacagaataatcacactttcggggcaaaagcatcgaatgcgtctttcatagctaacagctcttctttgatctgtttcaggcggtttacgatctcttcttggcggatcgtcgtctctttattgtccttcagtttttgccgtgcgccggccaaggtcatccctctctctttaaccagatggtagatgaggcgtaccgcgtcgatatcctcctgcttgtaaaaacgggtacctttgctcgtcttccttggattgatgatatcgaactccttctcccaaaagcgaagggtggactcgttcacgtcgaacatctgcgccacctcgctgatggaaaaatagagcttgagatctttattcttttttagactcatactgctaatgaagtttaatccataacctgaccatgattctcggcgatctggatcatacggtcgtattcctcaggtgagagatccatgtaatagtatttggacggattatcatgctttcctcgtacgattacctcataatgcaagtgagggccggtagatttcccggtatttccaacctcgccaatcacctctccacgagtaaccttctgtccgacacgtttcttgaacttactcatatgaccgtataacgtctgatagccgtagccatgatcgataatcaaacaatttccgtatccctgtttccaagcggcgaaagtgacaacgccattacctgtcgcatagatctccgttcccactttagccgagaaatccattccggaatggaaacgaggtgtacggtaaatcgggtcgatacgtacgccatagccggaagcggtacgacgcagatccttattggaaatcggctggatcgccgggatacatttacttctctcttcttggttctttcctagagagatcagttcttccaaggaattggattggatatataattgcttacgtagcatatccatcttttgggtcgtggagacaacaagctccggattggacaggctcatcaaatgctcgtaacggtttgtccctccaaacccggctttccgaacggactcggggatggactcggcttggaagatcgcccggtacagattctcgtcacgctgttggatatcatccaatacgtctaacgcgttatttaagcgaagggaaagcacctcgtattgagtttgcaataggcggttctccttacgtaactgagattccatcggagagtccaccaaatgcatcatgacgaaaaaagtggctacgccgaacgctattccggtgcttaaatggcggagaacggtgaacagccggtctttgctagatgggtatacacgctcataattgagagtgttcggattgtataaatagtatgttttgcgacttttaaagagtttcatctacattttttgttatctgaatgcacgcaaaaataataatttgcagtacttttgcaaattgtttttcagaatattaacgagaactatataaatagattatgttgacagcaaaagaaatccgtgaatccttcaagcaattcttcgcttctaaggaacaccagatcgtgccttccgctccaatggtggtgaagggtgaccccacgttgatgtttacgaacgcgggaatgaatcagtttaaagatattatcttgggcaacgtgccccgtaagtatcctcgtgtcgcggactctcagaaatgtcttcgtgttagcggtaagcataacgatttagaggaggtaggacatgatacctatcatcatacgatgtttgagatgctcggaaactggtcgttcggagattattttaagaaagaggcgatcaactgggcttgggaatacttggtagaggtattgaagctgaatccggagcgtttatatgccaccgtattcgagggaagccccgctgaaggcttagatcgtgataacgaagctgctggttattgggagcaatatttaccgaaagatcatattctgaacggtaacaaacatgataacttctgggaaatgggggatacgggtccttgcggtccctgttccgagatccatatcgaccttcgttcggacgaggagcgtgcggcggttagcggcgccgatatggtaaataaggatcatccgcaggtaatcgagatctggaaccttgtgttcatgcaattcaaccgcaaggccgatggttctttggaaccgctgccggctaaggtgatcgataccggtatgggattcgagcgtctgtgtatggcattgcagggtaagacctcaaattatgatacggacgtattccaaccgattatcaaggtaattgcgggaatggcgggtacgacttacggtacggataaacagcaagacatcgccatgcgtgtgatcgccgaccacatccgtacgatcgctttcgctatcacggacggacagttgccttccaacgctaaggccggttatgtaatccgtcgtatcttgcggcgtgctgttcgttacggttatacgttcttggatcgcaaggaagcgtttatgtataagcttttgcccgtattgatcgagacgatgggcgacgcttatccggaattgatcgctcagaaaaccttgattgagaaggttatcaaggaggaggaagaatctttccttcgtaccttggaaaccggtatccgtttgctggataagaaaatggaggagacgaaggctgcgggcaagacggtcttgaatggcgtagatgcctttacattatatgatacctacggattcccgttggacttgacggaattgattcttcgtgagaacggcatggaagccgatatcgaggagttcaataaggctatgcagaagcagaaagagcgtgcccgtaacgccgccgctatcgagacaggcgactggatcacgctgaaagagggtgaatgtaagttcgtgggttatgatttgttcgaatgcgaggcagagatcttgcgttatcgccagatcaaacaaaagaataaagtattataccagatcgttctggatcaaaccccgttctatgcggaaatgggtggacaggtcggtgatacgggttggttgatcgccgacgacgagaagatcgacgtgatcgatacgaaacgagagaataatttgccggttcatttggttactaaactaccgaaggacgtaacggctacatttaccgcgaagatcaacgtgaaaaagcgtatccagtgtgagtgtaaccactctgccacgcaccttttgcatgaggcgttgcgtgaggtattaggtacgcacgtagagcagaaaggttcgtatgtttcgcctgattctttacgtttcgacttctctcatttccagaaagtgacggacgaggaaatccgtaaggtggaaatattggttggagagaagatccgtgcgaacttcccgttggaagagcatcgcaatatgccgatcgccgaagcaaaggcgctaggggctatggctttgttcggtgagaaatatggcgatgaggtacgtgtcgtgaaatacggaagctccgtggagctatgtggtggtacgcatatcccggcaaccggtatgatcggttctttgcgcgtgataggagagagctctatcgccgcaggagtccgtcgtatagaggcggttacggccgagggcgccgagcaattcgtatatgcccagcaagatctgatccgtgagttgcgtgcgttgatgaaccatatgccgaatttggcgcaagcgatgaaaaagtctatcgaggagaacgccgagatgaagaaacagatcgaggattatatccgtgagaagtctatgcgtttgaaagaggagatcgtggcgaaagcttcggagagcaatggtatcaaggttatgcagttcgttggtaaggcaaatgcggacgctatgaagaacgtggctttccagatcaaggcggagacaaccgatagctttgtctttgttgccggtatcatagacgataacaaatgcacgctcatgcttatgttaagcgatgatttggtgaaagagggcttgcatgccggtaagatcgtaaaagaggccgctaagcatatccaaggcggtggtggtggacaaccccatttcgctacggccggcggtaagaacatggagggcctttccattgcggttggcgctgtgaaagaggctgttggagtacagtaaaatcggttcggaagaaattgacttttctttcggacttaatgatagattccttcggatcgaataagaattccatccgaaggaatttttttatgtcgttttgataatcggaatacatgttttacctttgtggtctaaggttttaaataaaaaagatatgtcagagcaaaaagtggttatttgcaaggacctgaaatcggaactgcaagattttctctcctctctaaaatacgataagttgttcatccttatggatacgaataccaaagagaaatgttttcccttggtagaggatataccggcctttcaaaaggcgccgattctcgtgatggaagcgggtgatatgaataagggttttgtctcattagcccagatatggacagctttgtcgaatgagggggcttcccgtaactccttgctggtgaatttgggcggcggtatgattacggatatgggtggttttgccggcgctactttcaagcggggcatccgtacgatcaatatccctacgaccttgatggcgtccgtcgatgctgcggttggcggtaagacgggtataaacttcaatgggttgaagaacgaggtcggttctttttatccccccttgtgtgtattcatcgattgcgattttttgcgcacgttggatcgcgataatatcctttccggttatgcggagatgatcaagcacgggttgattagttcgatggagaattatgcgtctgtcatgctttttgatatcgacaccatgaattattcgtatttgaatagtttggtaggccagtcggtcgccgtgaaagagcggatcgtagaggaagatcccaaggaacaaggtattcgtaaggcattgaatttcggtcatacgatcggccacgctttcgagagcttgtctttcctgaaaatgcgtccgatcttgcatggtcatgcggtagcggcgggtatcgtgagcgagctttacctctcgcataagctgtgtggcttcccgatggagaaattgagtcaagtcgtttattatataaaagagtattatccggcgctcttctttgactgcacggactacgataccttatatgagttaatgacacatgataaaaagaatgagggcggtatcatcaacttcactttactgaaaaatgtaggggatgtccgtatcaaccaatcggtcaccaaggaaaaaatcttggagtcccttgatttttatcgtgaaagttttggcatttaacggaaaaaaactacctttgcacccgtaaaataaaagcgggatgtagctcagcccggttagagtacgcgtctggggggcgtgtggtcgctggttcgaatccagtcatcccgactaaagctgagagaaaaggagttaagtctatggcttaactcctttttttgctctctatcactttcctaaaacaatgaggcagtagaaattccgactcatccgatattcatgggggatagccttaaatcatgacaatagattaaaattgatatatttccgtttgaatttagtgcggtcattccagcctattttagccattatttctgttaatggttgcttagtgccgacttatcggtgcatgctctgtgagttcaaagtcttttggggcacgattgtttatcggagtagggaggcctagctgtttgatagagtgccattggctgctgaagtgaataactaacggcttgtcgaatgaataactagcggctatatatagccgctaactaacggctcgggaagtgaataactgatcacttggaaagccttctacggcctgcgaaatcaagtatgcgttaacctagaggaggatttttggaaattatattatatatgtacacgtacattaaagaatatgatgtatatgaataggctttagtaatacataccaataatatcaaggactgatttatctaataaaacggctagtataaacgatcgttttaattcgtcatttgcaaaggtacgcgtttctttgatacctgcaacccttccgagctatttttttcatcccttattcgctttcttatcaataggatagcctatcctttacgaaacaaccgattccgtaaacaaacctcccgttttccctcttcaaaaacgcaagatctaaatgatggtctagactagtcgttttggtatggcgaaggataattaaagagttgggagatatttaattaacactattattaatatttaaattagagattatgaacaaagggatttttactttgatgacagcggctttattggcctctggatcagttgtaacacctgctttcgctgaagcgacgtttgcgacttatcaagccgtgaacacgaacaaggttttggcgaacggtgtgaagttctatttgcaggtaggcagcgatgaggctacctccactcaaactgatacgaagtattacaaagttaaaaagttaacaattaaggacaaggctacggtttggtctttagaagagactttaaaccctgacgaggcttctgttttcgaggttggcaattacactaaggttggtggacagtacaccttctccttgtctgttgacggcaataagatttctttgacgaaagacggtgtaattaaatcagacgctgctactactacagaggcttctaaaactgtgactactttaatcacagacaagaacaaattaagcgaattgaaaaaattctccgcttctttgatgaacgctacggctatcaacgtggttttggctacacaagaagaggtgatgacggctgatatgttgaacgactacaacacggaaggtttcactttcggcttcaacactaagacagacttggaaggtaacgctttcgctaaaccgatgtatgcggtagagatcggggacgatgctactactttagatgccggtacttatttcgttgtaggcggtaaggatgatgctgttaaggcattgaaaaaagcagtgaaagataaagaaggagtagaggaggccttggctacggaggatatccaacttcttgctttgaatatagataaaaaatatgacgtaaggggcgctaaatctccggcttacattctacaggttatcaacggtgataagatcactgggaataaggcagctttctctgttaaggagttcgataagttggcgaatgaaggtgagtatgagctgaaaatagaagatcctaaacaagataagactgtagagggaactgaatatgtgtacgtaggtgctatgcgctttactgctacagatacgaagacttatgtgacaacggttaaggaaaatgagaaatctttattgatctccgctactttaggcgctagcacttatttggatgcttccgttttattgaaggaaggcgtggctaactacgtgaatgtttactttactagtaacaaggaaagccaaaaagataacttccagactgagtatcacaaatatttggttccggtaactgttaaggaggagactaatagagctgctacttataagtttgcgttcgacgctaaggctgctaaagacgtaaacttcaactctgcgttatctcaatgggccgtgaagggcttcgacggtaaatatacatttacgttggtgaaccgtgaaacaactcaagagattactttaggcttgcaagagtctgacgtgaagggcgagtataaggtggttaacgctaagtctaatagcgccgatgtttctttcaattccttgaagaaagctgctccgggtgaagagggtgctgatgaggctaaacctgttaatagtacaacagttaagttcatcccggttgagaaagtcgctggtttcttggatttatccaaggatgagatggaagctggtatcaagttggaatttacgggtaagactgcgttaattggtgagaagactttctttgctaagaaagacaagaaaacagaagacgaaacaacaactgaaatgttggctcctagcatgaaggcttccgatgcattcacgctggctatcaataaggctaaaggtaagatcaatgatgaggataaagatgctgtcgtaaattacacgatccaacctcttgtattatcttgtttgaaagatggtaagattgtagagttgaaagatacattgtttgttccgacttacaatatctattatacgactccgcaagagggtaaagatgatatcgttacttacttaggtgaagacttggaatttgcaacggtaagcggcactgaaaaacctgctgaattcgtattccgcgcaaacgctgacggttcttacgctatgatgggaactgacgcaaatgtttcgtttgatgaggatatcactgccggtacaaacgttgtaagcgtagatcctactacaggtacaaaattctcaacagaggaggtattattatataacctgtcagaaggcagcttcgctagcgtagctgttaaggtacaagataattcagacaagactacattgcctgctgagtctcgtcacgcttcattcgacaatgcgctgggttctatcaactatcagttgaataagaatggtatcactgagggtatcctttccgctgagagcatgatcttctggttggatacagcggatagcaaggctacaactccgtacttctatatctctaagggtattgaggttgctgaaggcgaagagaaaccggccgagagaatgttcatgtataacgctacagactctatgtctatcttcgatgagaactctgctcaggcttctttcaacgagaagtatatgctggaaggtacaactaaagaggataagatcgctaaggtaatcttccgtccggctactatcgcaggtgttgacacgatcaatacggttgtagagggtaaggctgctgttgttgctgctaaggaaaacaaggcagaagaagtattggctggcttggataacttcaagttcggtatctgcttggctgacgatgctgtggatggcgagtatgttatctactcaaaggcagataacaagtatgtatacgctaagaacggtaagttaggtttgggtggaaaggaagaggctatggtcttcacgttaggtactgaggttccgacttctaacgagtctatcgacaacgccgcttcttctatcgtagtaacaggcaacgccggttccgtaacgatccaaggcgctcaaggcgagacggcttatgttcgcaacttattgggtatgccgttggcagagacagttgtcacttccgataacgctacgatcgctgttcctgccggaatcgttcttgtaacggttggcgacgagaccgtaaaggttgtcgttaaataagacatgtaaaggaataatgaaaagataaatcgaaaatcattcccgtgcgggaaaccaagtaccccgagagggcgaacaagcgggaatggattaatattaatactaaagtaataaattaaagttcatccgtaagtacttccgtgaggatggaaacggatcaaaggcaaggggagacagtattgcgctgtttccccttatttgttgataagggtagataagggctttgttggtgaaatggacggtattcgatctttttgattgatataagggggatatcgtgacataccctttttgagagaggtatgaagtaggggagatcggaggggtataaatagcctttttcatgcaaaaggaccactttttacacacgataggtggtaaaaggcagtgcgactagtcgtgtttggcaacgacagtagtgccgttgggcatcgtaaacagtcatgaatagggttgttagtactcatgaatgggcatcgtaaccctgttatatccctgtcgtaactcaatgagatagcccggataagctataggatatgaattaggatgaattaaattcgctaggataaaaggctgtttttaactaatgccgtataagacaaatgattgctaatattttttctcgtatttggggataagctgtacgtttgcccgaaaaaagtgattctcgggcagttgagtttacaaattgacaaaatgccaaggtgctttttttgtgagcttataggaagggctagatccgaaaataaaccttgattttagagaatggcatgggataaattccatgcttgtacgtgctttattccttctttggaaggaagcggcagatcatcgagcgagacaacgatcttctcgtaattatcctcaatggcctctaacgaggcatattcccgttcgatggtttctttgtcgattagtaaataagtggattggagatagataaccctctctcctttgatagcgacgaaatccacctctttgttctttatgctgcctacgtatatttgatagccggcccttaataaatctagataaatgaggttttctagtttatacccaatgccgtagccaaagccttgatataaataattgttgaaacctaggtcattgatgtaatacttacaattcccggcgatggtctcctttcccttgatttggtatttctcgactttatgtaccaaaaaagtgtcctctatgtaactaatgtaggaggcgatcgtatcatagctggtcttccttcccgagctcttgaaataattggtgatattccgaattgatattaaattagatgcgttatttaccagatagacaaaaatgtcctcaagcaacttagcgtcttttatgttttgtctttgtatgatatcacgtagtaatacggtgtcttttaatgcggatatataatttctttgtacttctggttgagatagatggtataattcaggcataccactactttgcatatattctaggtagtgtaccttgttgttttctttttgggtgattccaagaaactctgtgtatgaaaaaggatagatggcaaattccacataacgtccggctaataacgtggcgagttctccagatagcattttagagttggagccactaatgaataactcatattcggcggtatagtcctgtgagtatgagttggcgaagcgttcccatccctctacattttggatttcgtcaatgaacagatagatacgaccttgaggatttatttgttttaagtagagattaaacagggaatcaagatcttcattggttttcaaaaaatagaaggcggatagctcacagttaatgaagaatatatttcggggatttactccactattggcgagatggctagctaactgacgaaggagatagcttttccctacacgtcgctgtcctaccaagactttgattaatctgtttccggtgtaggataatatcctatctaaataatcttgccgtttatagcctgttggaaaatcgtttccaccccataggttatacttctctaatgtcttaaatctatcgtccatactcgaaacttttgcgtaaaagtacaaaagtttcgaatgaactcgaaacttttcccgttaagaatgggatatacccttaaaaaataacggcaaccgccttccgccgaaagccgagttgccgttcaaagttaggaataaggtttggtttgttcctttgtaatgattctaacattaatatgtaatgagagttttctacattttatcgatacaaaagtaaatgccacttgttacgatttgattacgggagtgttacatttttagtaaaggtctcgccaaatcggttgataaccttgatctgtacgtctttgactccggctgaagggtggcaacggaataagtgcgatgtatgatatccggaaggttttccgtgcatgtcgatatagtcttggtcttcatcatcgaattgctccatgcaacctttctctatgccgttttcgctccatgtaacttggtaggtcgggtcccaatcccatacgttcaccactaggtaatccgcttgcgatttgaactcattcggcctataaaccctgaattgataatccgaatcatggccggttgccttataataccaagtagcggcattccctttcacctcaacgaccagataaccgttcggggcgccgcaccgatttacatggccggcccaccaagctccgcaagcggctccgatattatgctcgtacagattcggtgtgacttggttgttctcgaagaaatgcgtatgcccggcgaagatatggacattataagggctgacgatctctttcaggctctcagcgtcctcggcgtttcctccccctttatccgtctggttgaataccggggcatgtacgttgataaatacaagtgttccgggtttaacgtaactcaggtcgtttttcagccattccagttgttcctttccgaagcgttcgtcatatttcttgtctttataataatcaatatcttttaaggtgatgatatgtgcatccccgacattgaacgaataattgtaagggccgaaatgatcctcgtagatacgctccgcatagctctcctcggttaccttttgattggataaggccgggtaacgtaagtcgtggtcgtgattgccgatcacggagaacatcgggatgcctaagaccgagaccgcttccttataaggagtgaataaatccatgcgatcccaagtaatgtctcccagcgccataccgtagacctcttttccttggtagcgctctatagtctgcttcaagtcggggatggtctcttcacggaaacgtttcatctgccgttcgtcgatggtctgaggatcggagattgccaagtagacaaacccgtcgattggctgtttcctaggggtgagcgtaaaatcatattcattgatctccttacttttatcaagttgctgatagaaaagatccggtataccttttgtttgctcgatctcatagtcacccggtacggagaggtagacaaagcggcttttgtccagattcgaatctaggctatattctccccgctcatttgtttgcgtgaaattataaccatccgtaacgactacgccttgtagcggtttgcctgccgtatcggatacagtgcctcttacggtagcggcttgcgctatccaagtggataacgcaagtaaaagcgtgaatgataagaattgtttcttcatcgtaattttttttatgatttgaatatagaatatgttagttagaatttataacgtacgccgatttgaatctgccaagggtttccgttcatattggatacacccgtgtttttgtttacgttatatacgtattgcttcttctccgcgtcaaaactcttgatggagtagatattctgcttgcctagattatgtccggcaccccagtccttgttcagcatattcaggaaattgaaaaagtctatcgaggcctcgatggaatgagtcttatagatcttgaagttcttgttcaagcgcaaatcgaaagtaccgtagaagccatttacgccaccgttacgctcggcaaccttcccatagtttttacggatataatcttttacgctcttctccgcttccgggttgtccaagatcgcttggataccctcacgaagatattgaggcgtattactatcgttcgggtcatagatataagccaagtcgttggatgatacgaaatcaccgttcatattaccactaaccgctaaagagtagcgggttccaccgatcccggagaaacgcaagcctacgctgattccccagaaagaaggagccgtaccgtagaatacgaccttatggcggaattggttgtccgagtaagtcatggtactcaaatcacgaggatcatcttttaccatcaaggctagagtcgctgtattcgctacgttaccgttgtaagaggtgttatccttggaatcgttccacgtatagctgaaagaaagctcgccatccttgaaataacgccaagttccatctaccacgaacgcatattggttgatttttccatcgctgattaattccagcacacggcctaccttatcacttttacgtccttgcatccagtcggtagctccgttcttggtattgatactctcggcggggacgaacacgccacgattcccctcggcggcgatacggaagtaaggctcatccaccatattacggtctacgtacatataattatggcgtgcccagttggcgtaagcactgatacctacccgcaagcgatcggagaagaaatgcgtgtagctggcgttcaacttatatactaccggtacacgggcatccttactattcatattgatcgtgctgatcttttggatattcgggttgttgaataaatcaacgcccggagcggtagaaggatctttgcggtatgccgggaaattcggtgtcggaaccaaattgccttgtatatccacggacgctaccttcgtaccgtcgaacagcatattgttgatcatggaatagttgtttaaatccgaaccgaagataccggcgccaaggcggataatatcttgatgtttatcattcacgtcccacgtgaattgaacgcggggttgcaactggaaggtggagattacgttgtccgtacgtaagcctagttcgtcataaacagtctggttaaagttcgcgtggttgaaataacgggtataatccgcacggataccggccatgacctcgaatccggtgaaaagcttcgtttgtaattgtccgtagatagcggagttcaaggtattcatctttacggtaggatcatctaccaaggcgatttcccgggcatagcggtaaggagtcatattctcgaaattatccagtcccgtgaaataaaaccgtccgttcatctcactgccgtagagtgatttcatattggtgtacatgaagtccgctccgaatgtatagttgatgcggtccgtattataatacatattgtctaccaattgaagtacattatccttgaaatgttcgggagcgtagcgttgacctccaagttggatggaagtgtacatgcttttgtcaccagatatagattccacgttctctacgattgctcttgggatattagagcttggcaattgcttgttcggggtcgtggcctcgtaaaccaagaaatgttgaagcttcaactcgttggtcagctttgggcttaataccgagcgtaaggtagcgagtaagctgttgttatgcgatttgcggtcgatccaaacctcgtaaagattgatactggagttatcgctctcgctctgtttattatcctcgttgatgaaattattgcgaatggttaacaagttggttgcgttcaactgccagtcgatacgggcgaagaccgcgttcgtctgcttcttcttaccgaactccccgaattgagggtcatttgagactccgtatttagtacgggcgatatccagataacggtctagcgtagattgagtgacattatagcgagactcgtccgccgccgtcttgatatccgctatataaatcggacgggaatcctgttggtgatcccatacgacatagaagtgcgcacggtctttcacgatcgggcctcccaaagagaaaccatattgataggtagagaagtcggaagtcgatttatttccccgtatatcataggaactggataaccaatcggcacgaccgaatccgaatacacttccggtgaaagtattggttcctgatttcgtgacagcgctcacggtgccgcccccggaacgtccgttggtcacgtcatattgattggttaccacctcaaactcgcggacggcttccatggatatcgtataagcgccggaagtcgttccgctcgctacggttcctttagccgtcataccgtcgatggtgtaattcgttgaggatgataattgcccggcgatatttcctccgctactcaatggcgagagatccatcagggaggtgaagttacggccgtttaccggaagcttcgtgatattttgagcggagatagatgttgccgcgccgatcttcggaaccatgttcttcaaggaattagcgactacctcgacagcttggatctccaccgattcctccgctagcttgaaatccactcgaagcatatccccttggttcaatgcgtatcctgtctttttctgttccccataaccgatataagaagctgtaacggtataaggagaacctagcggaagctgcttgatggtgtattctcctttatcgttcgtgatagagcccgtgaagaatccggtagattcattcttgacttggatcgtggctccgatcactgattcccctttattatccacgaccgtaccggtgataatcgcttgcgttccttgcgcagacaagagagccggcaagcaattaaaaaataacaaacaggcaagcagcctgcatgtaagtttgttaaacatcctcataataatctttttaaaattaaacctaaatatcttttacggcgcaaaagtaagtgtccggttttgcaaagagattacatccgtgtgtaggtttaaataaagaaaaaagcctaatgaaggatatccattaggctcaacgagaaaattataaatgtgtctataaaaaagaaggttagtcctcgtccaaagtcttgataatggtagatgctatcttggatgaactcttgcggctgctctttctgagtttatccgggttctcaagattcatgcaggtaaagaagttattccccctatatacctcatttttatctttgtcgaataaggtatagctgacgatatggaaaagcgtgcgcaagggttggtcttgccatttaagataatgctggtttaatactagcagataatcagcgtcagcattatccaataccttttgtaactcttcggtcggcacggctgaaagatcggaatagcaatcctcgctctccccgttaaccttgatctcattcagtacctgtccggtcacttgtgtagcgtttgccggaataaacttgcaatctccgttctttacggatgcggcgatattctcggcgatgatcgtattatacgtttggtcgatactatccgctttcataccggtctcttcggcgatcatcccattgtagaaatagtttgatttcacgttatcgtgcaaacctacgatgagaatttgctttgcatgataattgtcaccttccttcttactttctttagcgttcgctgctatagaagctacggctaaaaagaacataaccgtaaagattctgattttaaataacctttccatgattcttctattaaattctgtgtctattaatttcggaggcaaagatattagcggggtgttgcagggatattacggttgtataaagtaatagttaccgataatcccccctgtaccggcttggatattaaaatcgtggattcgttgtaaagtctattctaccgtgtggatgagttcaatcaaaaggcggttaccaagaaactttaaggagatatagaaacaagggttgtttttaaggttcaaagaacgctaaaaacaacccctgttatttttacttattattctcgatccacttgcgagcgttcacgaacgcctcgatccatggagtgacctcgtcgttctccttacggtcggcggggtaataaccgcactgccaagggaagatcgcacgttcggggtgaggcatcatggctaaatggcggccgtcctttgagcaaacaccggcaacggaccaaggagaaccgttcgggttggcgggatagccatcgtagttgtatttagcgatgatgttgtactccttctcctcgtaggggaactcgaacttaccttcaccatgagctacccatacacccaacttcgtgccgctcaaggagccgaacattacggagttgtttttcgggatctccaagctaacgaagttagactcgaacttatgggaatcattgtgaaccatcttatgctttttctcgtgctccggataaaccaagcctaactcggccatcaactggcaaccgttacagatacccatgctcaacgtatctttacgtgcgtaatagttgtcgatcgctttcttggctttctcgttatacaagaaaccgccggcccagcccttggcggaacctaatacgtcggagttggagaaaccaccgcagaatacgatgaagtttacatcctccaaagtctcacgtccgctagccaagtccgtcatatggacatccttcacgtcgaaaccagccagatacaaggcgtaagctgtctcacgctcgcattgcgtacccttctcacggattaccgcagccttgatgccgttcggagcgcggcgttcggctgagagtccgtaagaagaaagctttccggtaaagtccttgtggaacttgtactgtacgggctgcatcttatagttctcgaaacggtttccggcacaaacgcttccgctctgctttacatccagtttataagaagattcgtaccatacgtcacgcatatagtcgatgccgaagtgatattggatgccgtctttcgataccaatacatggcgctcgtcggtcggtttggcgatgatggcgaaacctacgccagcttcttccatcaacttttcgaatgccttcttgtcctttacctgaaccaagatacccggattctcggcaaacaggatcttcacgatatcgctctcggagatcttatccaagttgacatccaaaccaccctctacgttggcgaagcacatctctaacagggcggtgatcatacctcccgctgagatatcgtgtccggcaaggatgagtctcttctcgatcgcatcttgtacggcgttgaaagcgtcacggaagtattccggatctttcacggtcggaacctcattacccagcttgttcaaagcttgagcgaaagcggaaccacccaacttcaaggtatcgaaagagaagtctatataataaatgtatgtattcttgtcttgagctactaccggggagacgattttcttgatatcgctaacctctgcacctgcggagataatcaccgtacccggggcgatcaccttatcgtcgccatatttctgcgtcatggataaggagtccttaccggtcgggatattaatacctaagctgcaagcgaagtcggaagcggcttgtacggctgtgtacagacgggcatcctcaccttcgttacggcacggccacatccagttggcacttaaggatacgctctccaacttatctgtcagcggagcgaatacgatattggtcaatgactcggcgattgccataacggaaccggcggccggatcaaccatggctacctggggagcgtgaccgatagaagttgcgataccagctttcccgcggtaatccaacgctacggcacctaagtcgctcaacggcaattgtaattcaccttgacattgctggcgggcgatcttaccggttacggaacggtctactttgtttgttaaccaatccttgcaggctacggcctccaattgaagtacgttctccaaataatggtgaagttcggattctttgtaaacaaccggttgataagattcagtgaccgtatggtctgtcataaccgttctaggcggtttaccgaacatatattccagcttgatatcgataggttttacgccgtccgcttgttcgaagacaaacttcatgtcgttagtagtctcgcctaccacatacatcggggcacgttcacgatccgcgatacgttttacacgggctacatcttcttctttcatcaataagcccatgcgctcttggctctcgtttcctacgatctccttcgctgagagagtcgggtcaccaatcggcaatttgctcatatcgatgtgtccgccggtagcctccaccaactcagacaagcagttgaggtgtccacccgcaccatggtcatggatagagacgatcgggttctcgtcagactcggcgatcgcacggatcacgttagccgcacgtttctgcatttccgggttggcacgctgtacggcgttcaactcgataccgcttgtatattgccccgtgtttacggaagagacggctccaccacccataccgatacggtagttatcgccaccgatcacaaccactttctcgcccggttccggatcgcccttcaaggcatcacgcatatttgcgaaacctacaccgccggcaagcatgattactttgtcgtaagcgtatttcttatcgttctccgtgtgctcgaaagtcaataaagaaccacagataagcggctggccaaatttattaccgaaatcggaagcgccattggaagccttgatcaagatctgctccggagtctggtataaccaaggacgagggtctaggactttctcccattcgcgagcgccttccgtacgagggtaagaggtcatatagaccgctgttcccgctatcggcaaggatgccttaccaccgcccagacggtcacgaatctcaccacctgttccggtagcggcaccgttgaacggctcaacggttgtcgggaagttatgcgtctcggctttcaaggagataaccgtcttgatatcttttacggcgaagaaatcgggtttgtcaccggataggggagcgaattgctctaccgtcggtccttcattgaacgctacgttatctttataagcggaaaccaatttattagggttctcggcggaagttttcttgatcaagttgaacaaggaactttctttttcctcgccgtcgatgatgaatacacctccgaatattttatgtcggcagtgttccgagtttacttgggagaaaccgaacacctcgctatcggtcaacttacgtcccaacttctggcttacctcgttcaagtaagcgatctcctcttggcttagagccaagccctcttgttggttgtacacttccaaatcctcaatgtagacaataggatccggttttttactgatcgtgaagatctcctgattcaagccattgtagatacgttgcaacatcggatcgtgatccgcatcgccagaagaaacaggaaaatattcctcaatacgggaaataccggtcaggcccatgttctgggtaatttcaacggcgttcgtactccacggggtaatcatttcccggcgtggccctacgtaccagccttccaatgtttctgattgaacaggagtcgcctcgctaaacaaccaaaccagtttttgagtgtcttcaggagagaaagcgtgcgcggcctctacagccagcaccgtctttgttgaagattgaaagaatagaatcatatcgttgatttattagtatttatcacgaaataacgaataagcctcttttagagagtgcaaagataatgatttcccgtgaattattatgtcaatacgttttaaaagaaaagagggcggaacctcccggtctcgccctctcatgtcccctgcatagtaaaaaataagagtgtgtctatattctaccagcctgcgttctgttgtgcggctagcgtggggtttcttaatatatcattcaatggaatcggccaaataaagcgtttatccgtgtacgggatgaactgtttgctgttgccgaaccattcagctttcacttctccaccaacaacgaatgcgccttggttcttcacattgttatattcgattttagcgggaataccaccggacggcagcaagtcgtcagccgctaaacgatgaatgtcttcccaacggcgaccttcaccttggaactcaatgcgacgctcccaaaggatagcttccaccagtgctttcgtgttggcgaaatcgcttgccttatacgtctgtgtagcggggtcggccaaagaacggtctcttacttgattcaatttctccaatgcgagagtcttgtctcccgcacgtgcggcagcctcggcctcgtttagcaatacctcggcatagcgcaggatcggggcgtactcttcacgtgtttggggattctggtatttatcacagaagtaataatcgtcagacgcacgataaaggacgaggttacgacgcttgtcatcccctttccagaatttggagttgtaaagggtaggggatgtcgggcacatcgcacggccaccttcacgggcagacatcatagcggacatagctccatttacagatgcgttatcttgagagtcattcggaatggagaatatagattcctgattgtctttgtaagaaacgaaaggagtggcaggattggtttccagaatgaaacgtccgccttccagtttcttagcttcagtaactacattgttccaatcacgcatatgtaaatatacgcgcgttttcaatgcgatggcggcacctttgctcgcacgtccgatcttatcagcatcaataatgtccggaagcatgctttccgcattattcaggtcgcttaatatctgatcgtaagtctccttaacggtagaacggcctatgctttgttgctcagcgagttggctggggtcgtttacggctttcgtgtaaataggcataccgtagttattgttaccttctacgttgtagggcagggcataatggatcatcaagttgtgataggttaacgcacgtaagaacaggcattctcctttgtactgattccctttctcttcggttatgacactcgccgctaccgcgccttctatacctgcgtataccgtattatagcggttaatagcctcgaaagaggtttcccacatcgccacgttattagcggtagtcaagttataggttgcggaataggtataatcatagaattgggcggttaggttcatatcttcaccgcgcatttcgccttgcaatatactggccgctccaaaaggataaccgcgtgcccacccaaagtcattcggatctacgtacataccacattgtgcggcatcgtaagctccgactacggctaactcgcaacgttcttctgtcccgtatgccgtaagctcggagaatttgtcaacaggttcaaggtctacgacgtcgctttcgcaggcggtgaacacgggtagcgagaacagggctgtccctaacgctactactgaaatgtttttatataattttttgtataacataattgtaacttttcttagtttgtgaaattagaatgtaatgttcgctccaaaagtgaatgaacgttgctgtggcataccgttccaatctacacctaaacgagagtttgtctcaggatccaatccggaataacctgtgatagtgagtaagttctgtccttgaacatagaaacgaatctttgtcatgttcagtttggatacgaccgccttcggtagtgtatagcctaaagctaacgtcgatagttttaggtaattgccgctctcaacgaagtgtgaatccgtatatccatcattgaataaggaagaggcgtctccataaccgatttttggagtcatgccgtcacccggttgctctggagaaatccagcggcctaagatttctgttccattgttggagaaatccatattgaacaatgcgctttgacgagaagcgttcatgatcttattacctccggagaagcggaagaatacatttaaatcgaaattcttgtaagaaactgtattattccaacctccgtaccaagtaggcatagatgaacctaataccttacggtcgctagcgtccaaggaagaagccttggagacatccgaagggttggaaggatcatattccgcatagtcgtaagagccgaatgtgtcgaattgcactaatgaaccgtccgccttactccagatcggattaccgtttgcggcgtttacgccgtaataatcatatccatataaagatctatatgactctccttcacgaatgattgtgtaattgtctacgatgtctgttccgccgtataagctcttcaccgtgttcttagctgtggagaagttgaaattagtttgccagttccaatctttggtagcgatgattgtagcgttaactgtcaattccataccggagttcttgatcttaccgatattatcaaaatatgagttgtaaggaataccagcggtaggtgctgtaggaacttccaacaccaagtctttggagttcttttgccaataagctagctcgaatgtcaggcggttattaaagaaagagccatccaatccgatatcgaaagtctcggttgtttcccatttaagctggctgttacccatacggttccaagcgatagctgtattcgatcctgctttcttcgccccgtaagttcccagataagggaaataattccctaggtcagagtttccgattgtagcgtagctggcacggatacgtaagtcgttaaaccaatcattaatagttgattcgctccagaatttttcgcgagagatacgccaagcggctgatcctccccagaatgtaccccagcgggtgtctttcggaaggctggataagccgtctgtgcggacggaggctccgatataatatttactatcatagttgtaattcgcacggaacatataggaggctaatcccataaacgttttacctccagatacgaatctctcaccaaatgtgttggaaatgatatggtcggtgaagaaagcatcggatatttgttgcacggttgcgtccgtatattcatattcttgatgggtgtactcttgtaccgctgtcgccgtcagattatgtacatcattgaatgtacggttaaagttgattacgttttgccagttccagttcgtgtatgtggtattgatttcttccaataagccgccatagccgtatccgtctcctgattccgggttccataccatgaaatctttaacattcgagatgtctaagccagcttgtgtctttaaagtcaatccgtccatgaatgtgatttcagcccatccaccacctaatacacgggtattggtcgtacggtttacgttattgtctaatgcccagacgatattctggataccattatcaatataggaaaggttgcttccgcgacctaatgtcttacggttttcagcgtcgatattgtaaccagtaggatcatccggattgaatacagatacgtttggaagcatacgagtgccggcgaaacctacgccacccaatgaattctcgtcattcatgacaccattaacccgggtacgggtcatctggccatttaatccgatgcgtaaccattttgtcgcttgttgtgtcaaatctgcctttaagctcaaacggtttaagtcattggcgcgaatgataccttcttgttccgtgaaacctaatgatacataatattggcttttatccgtaccaccactggcggataagctatgattgtgctggaaacctgtacggaaaatataatcattccagtttgtgtccggtccgttcggatcgtaaacagcctgtcctttcattccccagttctcgtatttctcgttagcgatagtcacgaaatctttcgctcccagaagatcatgcaatttagctgcgctggctgcgcttacatagccatcgtaagttacttgagtacgtcccttggagccttttttagttgtgatcaatacaactccatttgccgcacgggagccatagatagctgtagccgcaccgtctttcaatatttcaatggattcgatgtcattcgggttaatatcagacatcgcattgtaagaagcgtaagccattcctaagccggtttttccatcggcgttatcaccggtggcgatcggcatgccatctacgatgaataacggctgagagttagaactgatcgtactcataccacggatcttgaattgaggaccgcttcccaatacgccactaggagtcgtaacctgtacaccagcggcacgtccagctaattgagagtcgaaagacgctgttgccaagttgcttaagtcttcacctcctactttagatatggcactcgtcacatccttttttctttgagttccgtaaccgacaaccacgacttcatccaagttctgagagtcggactccatcgtgactttaatgattggttttactgccacttccacagatttcataccgatgtaggaaacgattagctttttcgcgttagaaggaacatccaaggtgaacgctccgttgtaatccgttacagtaccggtagtagtaccagctactacgatagaggctccaatgataggtccatcgtcttccgccgagataaccgtaccggtcaccttcgtggtctgagccgttgcgaacgctatacttgcgaacaagcatagtaatagataagttaaccttttcatagacacatactttttgtttaatttgttaataaatagatcgttgtaatcaattgttgccacttagtcgattgacttagtttccgaagaacttcatgagggtaaggtactttggtgttacttcctagcattgatgcgggattgagttaaaaataatttgcatattaatactatatattaatactagaatgtattaaattaacatataacttaaaataatccgtattgacaaagttccgtgtaagtttatttttattgtcaatatgtttgtttattgcaaatatatctttatatttgccgtacagccattaaaataaaatgcttgctgtaaatagtacaattagacataacagatgtttacataggttgcatgttctataatttattaagatatttataataattaataaatattgaacggaaaagtgatttagttcttcggagactaaggtgtttcataaatactatctaatgtatttaaataaaaaaagagtatctaataaagatactctttagatatatgtgaatagagtgacctattttgatttttataggcttttcggaggatataatgcgtcccaccactccggttgatctttcaaccacttagcgaaccatgcgtaaattgtgttattccacaagatacgtttctcataatccagtatatggtggttctctccttctacctggacaaacgctgtaggcttacccaataattttaatgcggtaaacatctggatgctctctccaatcggaacattcgtgtctgcggttccatgtaagaacaagatcggggtattgatcttgtctgcgttaaacagcggactttgtaaagtgtacatatcccgggcattccatggataactgttagcgctagccaacgagctgtatgaatatccccagtaaccttctccccaatagctggtgatgtcgctgattcccgcatgagacatggccgccgcgaatatatctgtttttgtttgtaggtattgagtcatgaaacctccgtatgaagcccccatgcaaccgattttcttcgtgttgacaaaaggatgctcctcacagaactttttcgtgccttcgatgatctcgtcagcggtaagtttaccccatgcgttgacatggcgtgcggagaactcttggccgaatccagtcgctccactgggctgtatgatgtagacgatgtaccctaagccggcgtatacatgcgaaggataacggctttccatcacccgggccgtaggagttgttcctccgtaataattcacgatcatcggatatttcttagttgcgtcaaaatgaggagggagatagaagcggccgtaaatcgtatccccttgggcggaaacgaaattccaatcttgcacttctcctaaagtgacgtctctcaagatctctttggagagatcgatcaagcaggaagaggcgtcgtttttcaggttataggtataaagcctttgggaattggaagcgcttaatccgaaataaaccatttcgaaagcttgattggcgatggagtaatcggagatgacatcttccttggcttgaagttgcttaatctttccgttggacgggtttagactatacatgcgaacacggtccttatctttcgccgtgatatagatttgtttatcgagggcgttccactcgtaggaatcgacagaggggtcaaaatctttcgtaagcggctttatacttttatctgctatattgtataggaataattgcccgtcactcgtattcgatgtctgtccttctttgatctttaatccgataccatcgaaagcctctccagacgcgtcaacgagtaattgggtggcatccggggagaaaacggcacggcttacgaatttctcaccttttataagggtatccacatgcatggttcgtagatccatcttatatatatatgtacgtgagaaagggcgctccgttaaattcggttccctgcgactgaatagcagatagtggccgtcttgagatacatcgttgatgtaagtagaagtatgtccataggtgagccgttggaacaatccggttcgcaggtcatatttatggataaacatacggtttctccatcccggttggcgatcatccggcaccagtatctcttggatctcttttcgttcttgcggtcctttctcccgtatggagaataatagatagtcttcggtaggcccgaagctgaaagaaccttcaggcaattggctggaaaggatgttctcctttttactggtagggtctaaggtcaccaattccgtgcctttcatccctttccgggtgtaataggccagattgcttttaggcatccagcgtaagctctgtccgttctcaactaatacggaaccggtagccttgtctagtatctgggtaaatgaggactgctttccgccgggataggtttcttgataggagacgataatgaattttccattcggggacaggctggcggattggatgcgtttaccatcaaatacatcacttaatgtataacgtttctccggattgacggtcgcggttaccaccgcgtctttttccgggttgaatgaggcttttaaggcattctctttgtggctctcagataaatatttaattacgatttcatagcgtcgcggctccaaggtcaacgaggcttctccttgggttagttttgtgagttgtccatccacgtagacttctgaaatctcagggccattgatccttaaggtgccttttgtatagcggtcactattcaggtagaaggaaaccaaatgtagcgcgtaggaagaggccgaggttggcaaggtcagctctccggaagacgccgcgtcaagggtttgtccgctttgggaaaggttgcagaaaggaacggtcgtgttcaatagttccttgtctgagaatctcttactgtttacatccaggctatctgccaagaagggtttcttcacctcgtaagggccggcgtaattataatgtcgcacgacaacctcatccgcccatagtgagcaacaggagcatagggctgaaagaattaagatgtttttgtttatcatgatatttgttatttagtataagataagaaagcgagatggcaggtatctctcagccatctcgctgtatcattatcttataagatttctatctcatctacgaacaagaatgcgggacttccggcgccaccgtgccattttggtagtttgctgctgttgatgataacctcgacatagcgggcctttaccggggcgaaggatatctcttggggatataatccgtccttgtcgttttgggttagctccgggattttcttggaagctacttccttgaaattcttgccatcgtcggatacctttacggttacggcggaggctcccatgatccaatcgcctttcaccacgtttgtgttgaaagataccttttggatttcggttggttcctttagatcgatcgtggcgtcaaggtcttttccttggaaacccagccaatggccggtcttgtaattactacctccacgtaagccgtctaccaatacctgtgccccgttgaaaacgtatcctttgctgggttgctctttcaaggtgatgggcttcatcgtcgctttattgaagaagatatcttctgagaagatgcggctcgtaccgttcggacggacaacgatcgccttgaattcgcaatcttggttgatctgtaccgggccttcatacttgatgctggcgatcgtaggatcgctaccgtctaccgtataatagatatctccttcacccaacttcgtcaaggctatgtcgagtgttccgttctccgtattggtggtcagggaggcgttaatatcgaagatatgctttccgtaattatatcccaagcgatcgtaaagttgtgtcatgcgggccacacggggcaggaacgtctgataatctttcttggacggatcgctccactggatatcggctacggcatcgatacggggcatgatcatgtattctacctgtgagaaggtcgggatatattccgtccagaggttggcttgcgccccgatcacgtacttctggtcttcaggagagataccggctgtcggctcaaaagaatatactttctctaacggcaagtaaccaccgatagcttcgggctcaagatccgtatccgctgattgatagtaatccagatatacatatgtattcggtgtcatgaccacgttatgcttttgcttggcggcctcgatacctccatccatgcctctccagctcattaccgtggcattcggggccaagcctccttctaggatctcgtcccagccgatgatatggcgtcctttgctctccacgaatttctccatgcgggagatcacgtagctttgcaaatactcctcggcggaatgcttcttatctcccttgataccttccgccttgatgcgagcttggcattttgggcatttctcccaacgtaccttcgggcactcatcaccacctacatggatatattcggacgggaaaagatcgatgacctcgctcaatacgtcttctaggaattgcatggatttctcgtttccggcgcagatcacgtcgtcggctactccccattgaccccatacgtcataagggcccccggtgcatcccagttccgggtaagtagccaaggctgccaattgatgtcccggcatatcgatttccgggatgatcgtgatatggcgttcagcggcatagttgatgacatcgcgaatctggtcttgtgtatagaagcccccgtattcttttccgtcatatgttccggagttatggccgatcacggtttccttacgtttagatccgatctgtgtcaattccggatatttcttgatctcgatacgccaaccttggtcatcggacagatgccagtggaacgtattttggttgtgcaaggcaaggatatcgagatacgtttttaccgaatccaccgggaagaaatggcggctgacatccagcatcatgcctctataggcaaaacggggatagtcgttgatggtagctgccggtaattctacgttcatcccttgggccgtggccgggatcgatttacgtaatgtctggataccataaaatacgccggcatccgtgcttccggcgatccgtatcccgttatcgctaacggtcagttgatatccttccggattctggatgctttggtcgataacgaggctgatccccttaccgggctggccggtagcggttgctaattcatagcccgtgatttccttgatataagaagcgaggaactcggcgttcttcttcatcttatcattgccctccggataaaatatcttcgtggatggacttaggacgaaaggatttccgttcgtcaatgttacttcttgtagcaaaggcactactccgtaatctccttttacggccttaccaccggagcaagcgatcattcccgtgcaaaatgtcaggacgagcgctagtttgcttaggctgttcatgtgtttagagtttagaacgtaaaacaataattgattcagtatcaccgcccaaagataaaaagaattagccgttttatctaatgcttttacacttttgatgcgataaccttagggactttgtctatatatagagactatttatcaactggtgcatgatcatccaacagttggtggacgatcatgcaacggctgttggatgatgaatacttctataagaaatgtctaaggaatatggaagaaacacctaagctctaaagggaaaagggccagggactaagggaaaagaaacgtcttcttgagaggtatttccttgtccttcttataatatgtattcacacgttttacggttgtgcagcggatgtaagcgtcatggcagtagatgagcgcttgccttttttcggcggcttcggcaagcatgcgcagtttctcgttgtatgacgtgaccggatacgtgtcgtaagcggagatccattccggggatacgctggctacaagggggataacatctccggcaaagacaaaagtccgatcttccgtatggatatagggaacaatttgccccggagtgtgcccatcatacaagcgtagctctatcgtggggcaaatcgaagtgtcggcatctagcagccgtaaggaattagcatccgcgacggcttgcatattctcgataaaataggaatctttctccaaggcgttcggatgaaggaaattctcccattgcttgcggctaacccagtggttcgcatttgggaatgagagaaataaatgtccggtagattcatccttttgcgtggtataaccgcaatgatcgaaatggagatgggtgaggacaacatccgtgatttcctccggttgaattccccggtttcgtagttccgtgccgaggtctaccaagttgaagaagcggtaataacttagttgttttaagtgtttatttcccgctccgttatctactaggacgatgcgtccgtcatctgtttttatgacaaggctacgcatggctagcacgcaaccatttgtctcgtcgctcggatagcgacggctccaagcgcttttaggaatggccccgaacatggcgcctccgtcggcgtagaagtagccggtatcgatgatttgtagtttcatggtttctgcattctttctttgggggagtaaaggtatggtttttatcatactcaatagtataataaatgtaaaaatgactggtttaaacgttcgtttagactagtcgtccgcgaagttaaccattaatttaaattaagcaacattcatttaaatcatttttcgattctattagtaataagacttataatcaatacattacatccaatattaaaattgtgtcaaatgcactatcccatccatcaaaatgactagtctaaaccaacgttttagctagtcatttttattagggactgcgctcagagatagcagaaagtaggtttttggtgtttgaatattgttaatctcaattaattataaccatttaataataaagatggaaaaatgtagtaagaagagcaagcaattgtgtttaagcttgttcaaaccaagtgttatgatgcttaccacgggattcctatgtatggcctcctttcaaggattggcggctgtggaaccctcgcacaactacggaccgaatgttgaatcggtcatgcaaaatggtaagactgttacggttaaggtttcagattcaatgggtgagttgatcggcgcgaacgtgttggtcaagggaactactatcggtaacgtaaccgacatgaacggctcggttacgttgcaagatgtgcccgcaaacgctgttttggaaatctcttatatcggttacacgaccaaggaagtcccggttggcagtcaaagtgttataaatgttacgttgtcggaagattcccaggctcttgaagaggtcgtggtcgtaggttacggtacgatggagaagaagcaagtgaccagctccgttacctcattgtctgccggcgatatgatgaagggtgtgggtggtgccgatatcaccagctctttgcaaggtaagatcagcggtttgatcttgcaaaataatggtagtgccaatggtacgaccacgatccagttgcgtggtttgacctctatcaactctggtaaggctccattgatcgttgtcgatggtttcccgggaggtgatattcgtgccttgaaccaagacgatatcaaatctatcgatgtgctgaaagatgcttccgctggtgcgatctatggtacacgtgctgcttcgggtgtgatcttgatcacaacgaagagtggttctaacacgaatggtaaagtaaaattgaattatagtactgagctttcgaagaaacaaaactatggccgtccagatatgatgaccgccgatgagtatcgtaatcgtacggacgtgaatatcattgattacgggcagaacgctgattggtgggacgctcttttgcagaaggataacttctcgcaaaaacatcacctctctttggagctaggtaccgagaacgcacaagtgtacacctctttcttctatgagaccaacgaaggcatcacgattaaggataaccgtaaggactatggtggacgcttgaatgcaaactttaagctgttcgatggttggttagagatccgtccgatcgtggattatcgtcagactgctcgtacttccgatggatcggatgaggataagaaggcaaacttcaagcaggcgttgtataataacccgactcgttccccatttgacccggaaagcccgagcggatataacgtatggaccggagaaactttggactacaatatcgtagcggatcgtatgctttccgactacgagggcttggataaatggtttaagcctgaggtgacgatgaaattgaacatcaagccgattgaaggtttgagctattctcagacattgggttacgagaaccgtcagtgggagttgcaccagttccgttctcgctatcaccgagaggaggtgacaaacaaccgcggtggttgggcgaaattggaattctcgaagaccgaacatcttacttctgagggttacttcacttacctgaaagaatttaagggaggtcatagcttaaatgccgttgccggttactcttatttcgagaagaatggagagaatttcaatgcggagaactatgatttcggtgtagaaggcctgaagtattgggacttggaatccggatcttatttgaccgacggtaaggcaaagatgggatctaaaaaagatattacggaacgtttgttcgctctttatgcccgtgccaattattcatataatgataaatatatggtaacggctacgatccgccatgagggttcctcgaagtttgccgcagagaaccgttggggtaatttctgggcgttgtctggaggttggcgtgtatctggtgaggaattcatgaaagagtttgattgggtaaatgacttgaagatccgtttcggttatggtgtgaccggtaataacgacttcgatgcttcctatatggctaatacgttaagtcgcgaccaatattggatgcttccgagtggtagctgggcgtttgtttatggaccgagctctaacgtgaacccttatttgggatgggaagagaagaaagagtggaatatcggtgtggattactcattctttggcaaccgtatgtatggtaagttcgattactatcgtcgtaagatcgatggcatgatctacgaggtgaatgttccacagccaccgtatccaaatggcaaacaatggcagaacattggcgagatggagagtaaaggatgggagttcgaggttggtggtgacatcatccagaataaggacttcacttggacttccagcttgaatatgagccataactcaggtaagatccttacgatgtatggtaacaattcacgtatggatggtaacgctatggatgaaccgggatggccgggcgatgcctctcgtattgaagagggggcagagatcggtgcgttccatatgtggaaattcgctggattcgacgataaaggagacttccttttgtacaataaggatggtgaggttatacctgcttcccaaaagagtgtagacgacaaacaatatatcggtaattatctacctaaggtgatgatgggatggaacaatacctttacctataagaattttgacttgggtattaatatgcgtagttggataggtttcgatgtcttgaatacttatccgatgtacttgggtatccagggacagagtggtgccggccagtggaatctttggaaaccggcgcttgacgatccgaagtataaggacattcgcggcgtgaagctgctttgtgactacttcttggaggatggctcgttcttgaaaattgatgcgattacgttaggttatacattggcgttgagtaagtatacaaaatgggcagagcgcctgcgtgtatatggaactgtcggcaatgtagcgactattacaggatatagcggacataatccggaagtgaatattaccggttgggaaggcggtgtcgataaggtttggaactgtgatccgatagttcgcacctatacgttaggtattcaagtaacattctaaaaaggtaagaagaaaatgaaaattagcaagataacaaattggttggtagccggagctgcttgcttgctgctgggtacctcttgtgacgtggatcctacgttctattcgcaggttgttcccgacacgtattatacgaatgcagacgcggtttggtcgcgttttaatcgtccttttacgcattggcgttggtgggtagctcataacgacgctcgtgtgcgcttgatggaagtgggaactgatgctatgtgtgtgcctactcgtggtaatgactggtttgatggcgccgtttatcagaacatgcatcatcatcattttatggatgatatgagcccgatgaaggatggatgggacttgacgacgatgggtgtggctcagtcgtggagtgccttggaggatttggagaatattgatttcgtatcggtgggtttgactgaggaggatcgtgtatcaatgattaatcagttgaacgtattggctgcctctttttatttggatggtttggacatgtttggtggtatgcctctttacacatctacgaaggaggatgtgaaggctcgtgctacagatgtggagactttccattttatcgactccttgttggatgtatctatgccgaatcttccgttgaaggagaccttgggagcacccgagacgaacgttatccatcgtgctgtggctgcggctttgaaggttcgtttgtatttcaacgctgaatcgtatatcaataaaccgatgtatgaggaggccgctaagatttgtcaggatattatcgatggaaagtatggtcagtataaattggccaaccatttcaccgagatatttggttggggtaatgagacttgcccggagattatctggacagtaccttccgagaatgccaaaggtgagacggatggtggtttgactgccttcactcttccctataatttcaaggatttcttagggggcttgcaggatgctagtggtaataatgggctttgcctatgccctagtcgcgatccggagggtaacttgtataagtttaacgtaggtaatccatacgagacattcaacgacaaggatatccgtaagcagcagtatgtatatgagggtggtcgcaaataccgtggtctgtttatcgttggtgagttgcaaaacccggatttccccgagtataaatgtctgggtgcccgcgagtatgccggcaaggtcttgaatgtcgtagaccagatcgctcatatcagccaggtgggcaatacggtagccagtcttaaggatctgacttctacgattgccgatgcagaggagaactcaggcgtgcgtgttcttaaatttagtcctctgcctaatcaagatgagttcaaggaacgtttcaacccagattgtcctgtaattcgtctgacagagatctattatactttggcggaatgtaagatgcgtttgggcgataagaatggtgcggccgatatcatcaactccatccgtaagcgtaacttcgagggtggaaacgacccggatcctgttaccgctgccaatttggataaataccgtatgctgaaggaatggatgcaagagttcttgcgcgaggcccgtcgtcgtacggacttgatccgttgggacgcatatgtgacagaggattggtgggatcataaggctacgaacgatgagaaatacaatcgttatccattgcatcaattgtcattgggtgcgaacccgttgttggaacagaacccgggatattaataagttagacttaatataaaaaaggaggtatgttgcagaggcatacctcctttttctgatatggcgtggaaaacgcagtagtacttacttgactggagaatatgtacttcatcgggcaaataagtatatattcgtagacgaagtaagtactactgcgttttccggcatataattttgattgatttataacgtgatgaaacaacaattaattagcttgtttttttgcggtgtattattattgcaaggttgtaccgaaaagaaaaatgaggcacaactagagaagactctatctgtctatcaagtagatttgaagtcggaatcacccaaagaaagtattgatcgatttctggccggtatggagatccggttgttacctttggagtcgggagacagtatcctgtttaaaggctccgcctctaccatccatttggcagatgatgatatattccttttagatgcttctcagcgtgtgattttccgtttcggcagggatggtaagttcaagaacaatatctttcggaacgggcaaggcccggaggaatataacgtgctattcaatatggctttgtttgacaataaggtttatgctttggataatacgaagatccagctgtatgactatgagggtaattatctcaaaactgttcccctgaaaaatgatggtcgtcaggtagctgtcgctaaagatggcacgatagctgtcgcttccaattatatccagccttatcagctaaccctatatcgtccggatggtacgatctccgaatatttacctagcgataagaacttattgaaacagcaaatctctcagtccacctatcattcgttgaagagatatggcgatcggatcttgttgacaaattattttgatccatccatctatcagctggaagataccgtgtctgccttcgccacgcttgacttcaaaggcatgaatatcccctccgatatgtttagtggtacggatgaggagatcgccaaccggttccgtgaataccgcgagggagataaggccattctctcattcgatcgcttgaccgttacggacgactgggttgtgtttgcgccttctttgatctgggatccatgtgtggtttattataaccgtaagtcggatacttatcttctgaataagaactgggggcaaccttacgatttgttcttcggaggctacagggcaccggacggatatgatgagaagagccgggagttttaccaactggtcaatgccgtagagctgaaagaggtcgtaggggaaatcgccaaagcggccccgaattatcaagatacctatccgtttttgaagggtgtggatgtatcccaaatagatgataatacgaatgattggattgtattctttaagttacggtcttagaggatatataacttgtatgggagaatatgaccgatctctgtattatcttcaacgatgtgatctgctattagttcttattcaaaatgggaggaattgcgtttgatcaagcgttttttcctgccagtcaagcgtattgtcaaggaaagtttttgagatcatatgttcttatcttgttccgataaaaaggaatgtctatctttgttcatggtaagtatatctaaacgatcatcgctatgaaccagacaatttatcctatcggcatacagaacttcgagaagatccgtaaagacggttatctctatattgataagacagctttgatttatcagttggttaagaccggaagttactatttcttgagtcgtccgcggcgtttcggcaagagtctcttgctatctacgttggaggcctatttccaaggaaagagggagctgttcgaggggttggcgatggaacggttggagaaagactgggaggtatatccgatcttgcatttggacttgaatgctcgtcattataaagatactgccgctctgactagtatcttgaatgagttcttggagaaatgggaggctttatatggaacggagaaacaggatcgtgccttggaggaacgtttcagttatgtgatagaacaggcttatcgccagaccgggcatcgcgtggtgatattgattgacgagtatgacaagcccttattgcagaacctgcacgatgaggatatgcaggatcagttgcagaacatgttgaagcctttttacggcgtgttgaagacgatggatggagccatccgtttcgccttgctgactggggtgacgaagtttggaaaggtaagcgtgtttagcgatttgaataacctcatggacatatcgatggacgatcgttacgtggagatatgtggcatcacggagaaagagatacatacttgtctggaagatgaggtgagggaactggccggagcgcaagatatgacctacgaggagacctgcctgagactcaaagaatgctatgatggataccatttcgtggagaattccatcggtatgtataatcctttcagcctgctgaatacgttcgctcgccggaaattcggcgattattggttcgagaccggtaggccctcttaccttgttgaattactcaagcatacccattacgacctttatgagatggcgaacacggagaccgatgtggatgtgttgaacagtattgactctgcctcgataaatcccgtccccgtgatctaccagagtggctacttgacgatcaaggattacgatcctgaatttggtatctaccggctaggtttcccgaaccgggaagtggaagagggtttcgtgaaatatctccttccattttacacgagtgttagtgcgcccaagacccctttcgagatcgggcaattcgtacgagagatacgctccggtgattacgatgcgttcttccgccgcttgcaaagcttcttcgctgatacaccctatgaggtgatcgccggtcagaagccggagcgtgatacggagttgcattaccggaacgtgctttttatcgtatttaagttggttggactttatacgcaggtggaatatcatacctcacaagggcgtattgatctcgttttaaagaccgatcgctatatctacgtgatggaattcaagctgaacggcaccgccgaggaggcgttgcgccagattgaggagagacagtatgcgcttccctttgcgagtgatccgcggcaagtttttaagatcggcgtgaacttctcctctgtgacccgtaacatcgagcgatggttggtggaataataatctattaagtatatgaactggaaacaaacgcttttctggtctttttcgacagttgctattttttattatttcctgctttttggcgtgtttgtgtttgtcggtcaggaggagatgcaattgtttatacctgagtggtggtatatccgggagttcctttttcagccgggaggattttgcgctgtcgccgggcaatggatcattcaatactaccggcagcctatgtcggcggtggttctccatacggttttactcgttggttgcgggtttatggtctataggatcttgcgttgtttttctgacaagacctacctgctgttcctttctttattgccggtcctgtatctggttaagatgagtattcatggggagtatttggtggacgggacggttggcgtggttttgatgcttttagctttgtcggtctcgctaaaggtgcggcgggcgggttctattgccggatacggaattgcctctacactttttttatgtgggctgactgggcttctttcggtttgttacgctttcttatatacgctgttagctttactccgctacaaaacgtcgcggcaaagattggccgccgctgcctgcttgatcccagcactttttatatatttgtttagcggatggttagggattcctgtacctttgtctgatggatggatgccggaagcctatctggagatacagcgattacctcattattatatgtatcgtgtatggactttctttaccctttcgattgtcggtgttgctttattcgctcgctttgttccggtgattggcgagaagagtaaatggatggatcgggtagcccttgttgtttgtctgatcacggcgctggtatccatacggttttgcctgccggaaccttggcatgcgcaacgcatgatgcttgacgagctctctttcttagcccgggagaggcaatgggacgctattattgataagtaccggggaaagcagatctataattatgctagcttaaactatttgaatatgtcgttggcccataagggagaattggccgaccggatgtttactttcgatcagaaaggaacgaaaagcttatgtgccgattggaatcagaccttttacatggatcgtttattgagcgatgttcattttcttattggcgatgtctctttgtctgaaagtcttgcgatggacggatttacgcaagccaaacgtaaagggagtgcccgcatgatgcaacgtttcgtgcaagtttgtctgattaggggtgaggtggcgctggccaagaaatatttggacttgcttgccgctatgccattctataaagattgggcttgccgttatgctacctatctggtacatccggaattaatggataaagatccggagttgagtgacaaatatatgcctgttgagaaaagggatcgactgagtttgtccgtacctgtcgattccttatggagtggatacaatcttccggatcatcggatcggttgggaataccggggatgttattatttgttgggtaagaagctggatgcatttggccgattcttggaagaaacacctttcatgaagggggaaccgataccccggcatttccaagaagccggattgttgttggcggacaaagacagtatatcgctttcctcctattccatacagccggagatcgtagaccgataccgggaattcaagcaggttttgggacgatctgccaaccaagtggatgtgtcctcgatatatcgacaatttggagatacctattggtattatttctatttcaagatctttaaaggagaagaacaatgaagcgattatctatctgttggattataggttgtcttttggaacttgtagcttgtaggccggaagttcctacgcaagcggaacaaggagaaactgacgtgtttccggattacagggaagttactgtaccggtcaatatggcccctcccaatttcaagttggttgatcaacagctacaggggataattcggttgaaaactatgaatggggagttgataatcgcagccgatcatggtgttttcaacctgccggaaacggattggaaggtcttatcgcaggacgcacaaggaaaacaaatagatgtgacggtttattttcgagaacctcaaagtgattggaaacaaatgagtttccctatctatgtgtcaagagattccgttgacgcttatttggtgtatcgccgtatttttcccggatatcggatgtggaacgagatggggatttatcaacgatgtgttgaaaactatgttgaaaagtctattcttgataaccaatcgacaaataatagttgtatgaactgccatgccttttgtgagcgacaaggggaacaaatgctttttcatcagcggggttctcataatgggacttacttgattgatcatcggcaggtaaagaagattgcgttggaacgggacggtaagccggcttcgttcgtttatccgtattggcatccatccggccggtatgttgctttttctaccaatgagacccaccaggacttccatctttccgatgagaatcggattgaggtatatgacgtggaatcggacgtgctgatctatgacacggagaaggagagggtattcagttcgccattattggcttctatggcgtgttatgagacttttcccacttttactccggatggcaactatctgctgttctgttcggcggattctgtctgtatgccagaaaattatcgggatgtccggtataacctgttacgagtcgcttttgatccgaaagacggttcgattggaacccaagtggataccttatataatgcgagagaagcgggccggagtgttaagttcccgagagtctccccggatgggaagcggctactttatacggtgtccgattatggcaatttctctatttggcataaggatgcggatttgcatatgctggatctgtctaccggggcaatcgattctttgccggaagtgaatagcccggatgtagagagctatcattcttggagcggcaatagtcgttggtttgtcttttccagccggcggggcgatgggcttttcacacgtccgtatttggtgcatgtggatgagcgggggcagtgcggcaagcccttcttgttaccgcaagcgtctccggattattatgagcgttccctgttctcttttaatgtcccggaatttatacggactccggttctaatctcgaaggaaaggctggtcgaggcctcgggaaaagaagaggtcacgaccattaaacgtatcgagggcatctaatttttcgcttctttgtgccgaaggtatttataaaagtcgtacttttgcgctaaaatcaaaacgatgcgaaaagttcatttgatctccgtaaccgaacctttggttttagatctagccctagcacttcgagaaaaaggatatgaggtaagcgcttccggttgtggtctgactgaagagatgataggaagacttcataacgcaggctgtacctgttatggggatgggtggtttccggagaaattaataaaagatattcactcggtggttttgggtgctaaagtaaagcaagataacccggaattattgcgtgcgaaggaattggggatgttaatccaatccattccggaatttatatttcaacggactcggtcgaaaactcgggttgttgtggcgggtagtcgtggaaagaagacaattatttccatgatggtctgtgcgttgcgccggcaaaagttggcgttcgactatgcgttgactagcaaggtggactcgcttccgaaccggatacatttgagttatgaggcacgtatcgctttgatcgaaggagatgagcatatcacctctgccttggacaagcgtttccaattggaattctatcgtccgcatatcgccatcctgacgaatttatcttggtctaccgagacggatcatgcgactccggaggcctatttatccacttatcaatctttctccgtttctattgagcgggaagggaaattgatttattttggaggtgatgatactgtcagtcagttggcaggggacgtccggagcgatatcaccgctatcccttttgaggaacatccggtcgtggagaaagacgggcagacttttctgcatactcgctacggagactatccggtgcggattcccaatcgctatttcttgatcaatctgaatgcggcacgtttggcttgccggcagttaggcgttaaagacgcggatttttatcaagcgttatcggaatatagtttatctttgccgatatgataatagctagacaaaaaagaaaagagaatatcgctgaatatctgctttatatgtggcaggttgaggacttgatccgggcgaataagttcgatatggattcgatcaaccgcacggtgatcgcccattacgaccagcccgaggaggtgaagaaggaaatcgctcaatggtacgaggaattgatcgagatgatgcgtagcgaaggggtgatggagaaaggtcatatccaattgaacaagaatgtgattattactttgaccgatttgcatcttcgtcttttgaaatctccgaaagagatggtttatagcgcagcttattataagacgcttccttatatcgtacagctccgggctaaatcgggtggagaggatctgccggagctagaaacttgtttcgccgccgtatatggctatctgcttttgcgtatgcaagggaaagaggtgagtgcggagacgttagagggtattaaacaaatcagttccttcttggcgttgctcgccgagaaatatcgggaagatatgaaaggggaacttaaactagaggattaataatagatatagacatgaagacagttttggtaaccggagcgaacggtcaattgggaaattctatccacgctcgtatcagccagtatcccggctataattttctttttacggatatagatacgttggatatttgcgacaaggaggccgtccggaaatatgtcttggaaaatgatgttcaatatgtcatgaattgcgccgcttatacggcggtggataaagcggaggagcatgaggatctgtgtatgcgcatcaaccgggatgcggtacggaacttaggtgaggccgctcatgccgtgggtgcgaaggtgattcatgtatctaccgattatgtgttcgatggaacgagttgccgtccttatctggaaagcgatgcgacttgtcctgtttccgtatatggacgtacgaaactggcgggagagcaggccttgatggaggtgtgtccggattccgtgattatccgtacggcttggttgtattccgagtatggaaacaattttatgaagacggtattgcgtttgggaaaggagcgggatgagttgcgtttcatattcgaccaagtgggtacgcctacttatgccggagatttagcggtcgctatgcttgccgtgctggaacgtgccgaggcgggtaaatttataccgggtatctatcatttctcggacgagggggtgtgtagctggtatgattttacggtaaagatcttgcaaatagcaggtatgaataaccgggtgatacccatagagaccaaggattatccgacaccggccagccggccgcattatagcgtattgaataaaggtaagataaaaagcacgtacggactgacgattccccattgggagactagcttggcctactgcatgaataacaaagtgtaactgataacaatatatacatataaaatagaatgagccagtattcagaagagattgaaagaagaagaacgtttgccataatcagccacccggatgccggtaagactacgcttaccgagaaattattgttatttggtggcgctatccatgtagcgggagcggtgaagtctaataaaatcaagaagactgccacgtccgactggatggagattgagaagcaacgcggtatctccgtagctacctccgtaatggcttttgattattccgatcataagattaatatcttggatacaccgggccaccaagatttcgccgaggatacgttccgtaccttgacggcggtggatagcgttattatcgtgatcgatatcgctaagggagtagaggcgcagactcgtaagttgatggaggtttgccgtatgcgtaagactccggtgatcgtttttgtcaacaagatggaccgtgatggtaaagatccttttgatttgctggatgagatagaagaagaattacagataaaggtacgcccattgagttggccgatcgatatgggacaacgtttccggggcgtatacaatattttcgagcagaaactgaacctatataccccgagtaagcaatatgtgacggagaatgtggaattcaaggatatcacgagtccggatctcgagacttatattgatcctacgcaagccgcaaagcttcgtgaggatatagagttgatagagggggtttatcccgaatttgatgtgaatacgtatttggatggggatatcgctccggtattctttggctccgctctgaataacttcggtgtgaaagagctattggattgctttatccgtatcgctccctcgccacgtccgatccatgcggtagagcgtgtggtagacccgaatgaggataatttcaccggctttattttcaagatccatgcgaatatggacccgaaccatcgcagttgtatcgcttttgtgaagatttgttccggtcgttttgagcgtaatgcgaactataagcatgtacgtttcggtaagatgatgcgtttcagtagcccgacggctttcatggctcagaagaaagaagtggtggatgaggcgttcgcgggtgatattatcggtttgccggataccgggaactttaagataggggatacgttgacttccggagaggaattgcatttcaaggggttgccgagcttctcgcccgagatgttcaaatatatagagaacgccgatccgatgaaggcaaagcaattgaacaagggcatcgagcaattgatggacgagggtgtcgcccagttgtttaccaatcaattcaatggccggaagattatcggtacggtgggacaattgcagtttgaggttattcaataccgcctgttgcatgagtatgccgctcaatgtaaatgggagccgatcagcctatataaggcttgctggatcgagagtgataaccaacaggcattggagaatttcaagaaacgtaaggcgcaatatatggcgttggataaggaaggccgtgatgtttatttagcggattccggctatgtattgatgatggcccaacaggattttccggatattaagttccattttacatcagagttctaatatgaaaagtcgattctccatcctttgcttacttgttaatatcttgttgataagttgtgaacaggctccccaatactatgaggtatccggaaggcttcatacaccttatcatattaagtttgagcatactaaaccattggataaggagattgacgagcagttgaaatatttctaccacctgtttaatgcttttgattctacttcggtaatcagtcaggtaaaccagaaccgtgacatacgggtagatacgctcttccaaaaagtctttaagaaggcactggaagtatctgccgagacaaatggggcctacgacgtgacgtgcgccccgttgatcaacctttgggggtttggcttcagccggaaggatagcgtaacccctgcccatatcgacagtgtccgtcagtttatcggttttcagaaagttcgtttagaaggggatcgcatcgtgaaggacgatcctcgcttaatgatgaacttttcttctttggcggatggaacggcttgcgatatgatagctcagatgctggagaagaaaggggtccgtaattatttggtggagtttggtggcgagatgcgtgtgaaaggcgtgaatccctcgggcatggattggcgcttagggatcacgaagcctacggatgacgctgctggcatgaatcaagaactcgagcagatcgttagcttcccgaaaccgttaggaatggctacatcaggcaattatcgtaatttttatataaaggatggacgtaaatacgcccatacgatcgatccccgtgaaggttgccctgtacagcgggatatccttagcgctacgattgtctccccggatgccatgaccgctgatgcgtatgctaccgcatttatggtcttaggttcggaggaggctaaatccttatgcgctaaagtgcccggccttgactattttattatttgttccgattcgataggagacgggtatcatccggaatactctgagggatttcgccgatacatggtgactgccgataagtaatcagttaatttataatgtattaagatgtagttcttagaataggcattgtaaggtctttatgatgcccattctaaggatcatataatgcccatcgtaagcactctataatgggcattgtaagaaaggatatcttataagatggaccggatctcatccaaggagcggactgtataggttgggatgaagcctacggcaggtaatccttcaggattcaaccatatctggtcgatcttggattggtaagccccaatgatatcagcttcccagctatccccgatcattaagctctcggaccggcgtgagttcgtgttctttaaggcgaagtcgaaaatacctttatggggtttttgtatattagcgtcctcggacaggatcatccgttcgaaataaggagccaagcctgcgttgctaagtttcttgaattgtacctcacggaatccattggataaaataaataaccgataggaagggcgaagatattccagtaattcaatggctccgggcactaatcgggttttggtggtcgtgcgttgcaagaaatcattatttaccgataagacggttttcttatcttctattcctaacggacgaagtacatagagaaatcgatccaagattaaggtttgccggtctatttcccctgaacgatacttggcccataagtctagattatgaggcatataaatatcaaagaaagcctcgaaggaggcataataccgattaaagtggtaatcggtatatagctcttcaaggcattctttattgttatggtacgtatcccaaagggtatcgtccaaatcgataaatatacttttataaatcattatccaacttcgatcactaaatacttgcctaggctccagaaagccttctcgtcatttattttcaaggtcaagtttccgtcttcatcctctacgaactcataagatccttccggatgattggattttagtttagccttgcttgcgaacaaaggaatttcttttacctcacggatatcgatagagatgaaataatccttgttgaaaccactctgcaatactttagatttagagaacaggccaccaccggataagatcttctgttccttcaattccttggaagtaccgaaacagtagtaagccgtgtgaagggctttatcttgagcgttcaatttctcggattgagcggctgcggtagtagccagactttccacatcctcattcaaggaacttaccatctcgtccaattcttggatacgtacgttcttctttgccaaatcctcttgcaaagcgacaatcatcgttgccttttgatccagctcggaggaaagacgatcgatcgtctttcgtaatgcggaagattgaataccgcttttcttcaatttctcctccaactggctgatttgctccttgttcttcttcaaggtctcgctgatcaattgcatgttctgcttgatttgatctctgcgtgactgatttagctcaccgccggtttgttgttggattgtcaaataattctcggcatcacgtatagattgaaaatcagattcaatatcatttagggtggagagcatatcattaagctcatccgtgttcttcgtattctcgatacgtagagaatcgttctcagcctttagtttcttgtaatccgctgaattttggccgcaagaggccagcatggctgtgcagacacatactaataatactttcttcatgttctttttgcttgttaagttaaacatctttttctgtctctttgtcctttttatcttttaagcctgctaatacaataacaatctcaccccttggttcgttcacggtaaaatgctgaattacttcttctaaggagcctcgtacggtttcctcgtgtaatttggatatttcccgggatactgatacttggcggtccgtaccgaaaaactcggcgaattgtgtcaaggtcttgagcagacggaaaggtgattcataaaaaataatagtccggtattccaaagccaattcttttagccgggtctgccttcctttcttttgagggagaaacccctcgaaacagaacttctcattgggtaatccggacgctaccaaggcgggcacgaaagctgtagctccgggcaggcactctacgtctaccccttggcgaacacattccctcaccaacatgaatcccggatcggagatggccggcgtaccggcatcggaaacaagggcgatattctcgcctcccttgatacgggccgcgatttgctccaccgtcttatgttcattgaacttgtggtgggactgcatcttgttttgtatctcgaaatgtttcagcaagatgccggtcgtacgggtatcctccgctaaaataagatcagcttcttttagcacacggatcgcccggaatgtcatatcttccaagttaccaacaggggttgggactacagtcaattttgccatatcgtatatttatgagaagcgtttttccaatagcttgatgaaatcggctacggaagcgtcttctatattccagttcaacaccttgttcagataagtgaccgattcctcgtacgagctaagatcgttcaggtctgagatcgccttattcattttctcctcatttcctccgaataattcccttctgaagcggaaacgatcatttaaactgaatgccttacggaaatcagaaagattctttttctccaatatatcattcagtgaaatactggatttatccgctaatatagttttatgtggaatctctatctctttcaaggggattgtctcttgtacgatcttttcttctgggatcactttttcgacaattggttctactacgataggttcctcaacgaccggttcttgtacctgtacgacctcgatcgtaggggatacttccggagccggttgcacctccggcatctgtaaaggtttacttacgggaatagaatcgataagtcgttgatgttcctccatttgtttacgcaaagcctctaactgaaactcctccagcgtatgaagctccttcaataccttgtgggtcaactggaaggtctggttgaagaaagaggcgggataaatttccgcgtccctcattccggctaccaacttctccagctccctgatatcgatcaatagataatctattttttccttgtttgccatttctatatgtttttcagatgctataaatcatccggacatacgtatgttttgcaacaaaaataagtatttcttgtcaatgttgccagtttcgatcttaaaatattgtaaatcattcgacgaactcgtccggtaaattcaccagatataggtgatgggtcgcccgggtaaaagccgtgtagagccaccgatagaaatcctcaccaagcatttcctccgtgatgtaaccgatatcgagaaagacgttcatccattggccgccttgggctttatggcaggttaccgcataagcgtattttacttggacgacgttgtaatgaggatctaccttcatctttttcatttttcccgccttggtaggaatgtcctcgtaatcttccaatatggtgtaaaagagcttgtcgtttagctccttagggagggcgggggagtcggtctgtaaagtatctaataggattttcaaatcgatttccagatcataatcttgaaaacgagccgtgatgtcggcaaagcggaagccatacatctccgtgacacggcgtactcgcatgacttgaatgatctctccgttcgctataaagtccatctccttgcaattcgctgtccaataataattgttcttcgctaccattaaatgatcgccggacgatagctcttcttccctgtataggatacggttacgtatgccgttattataaatcgttgctcgtttattcgagcgggagataatcattgtctcttccataccgtcgcggctataggcggaagatatttcctcaattagctcatctccattgactttcgtgaaatcggagaagccttttaattgtaatttcggaaagatctcgaccgtgtggtttcgtagtgcgtctcgtagccgggttgcgttgaacaggattcccgagtcctcgctttggcgtacgacttgagttaacgctatctcccaaacctgtaggttgtaaccccgtaatatctcgggattcaaggcgggactctccgtttgcatcaccggaggaagctgtgcgacatctcccattaggataagacggcagttttccccggaatagacatactggattaaatcgtccaacaggcgtccggagccaaaaacaaatgaatccaatccctcgttggcgatcatagaagcctcgtcgacgataaaaagtgtatctttatgtaaattatctgccggcatgaagcccgtcggctcattggaaaacgcccgttgacgatatatttttttatgaattgtatacgctttttggccagcgtagcccgagaaaactttagctgctcgtccggttggagccaacaaaaacgttttttgctttagttcgttaagcgttttcaccaaagccccgaccagagaggtttttccggttcctgcgtagcctttcatcagtagaaggctgtccggttcctcagacaagagaaattcggtaagcgtatgaagcgctaaaaactgatcatccgtcggtttataggggaaatttcgttcgatttgctggcttatgtaactatttatcattttgatcgcaataattttcgcgataaaggtagtgtattaaatattcttttttaaatttgccgaacgaaataaattcaaaaaacaatacaaaccatgaaagttacattaaagattttattagctgccgcagttgtactgctagtttacatgtgctacaagagcgtcactggtccgattgagtatgatgatcagaagactattcgtgacaatgcgatcatcgcccgtttgattgaaatccgtaaggctcagatcgaatacaagaacatgtataagactcatgccggaagtttcgacgatttggagaaattcttgaatacggataagttgccgttcttgatcaaggaaggtgtattgacggatgagcagttggagaaaggtatgacagaagcagaggctgttaagaaaggtttaatcagacgtgataccatgtgggtattggcgaaagatactttgctgggtaagaactatgatgtagcggctatgcgttatgttccggccgttccgggtgaaaagattactttcaagatggatacggctacgttgaaatctggttctggttatgagatcaaagtattcgcttgtgaggttccttacaaagaatatttgcgtgacatggatgctcagttgacttataacttgatcgacaaggcagagaaacaaggtaagttcccgggattgcgcgtaggttctttggaagaaattaataacaacgcaggtaactgggaataatcagcggctcatatgactatcagcattcctgatacgttaactactgataattcggaaaagtatatagtgtccatccggcttcggtcgggtggactttctttttccgggtatgatccctcggctggaggaagtttcttttatcgggaaacggaattcgatcgggcggtctctttcatttcttcccttaaggagtttttcttcgctcatgagtttcttacgtggacttataaacggattaacgtgatctgtgtatctccggaatatagcttggtccctgataattattggggggacggtaaggaagggcatttattggatttctgcttttctacactggaattgcattgcttaaccgatattttaaaggaacaacaggctaagttggtgtttggtgtggacgaggaggtttacgaattttgctcccgttctcttttgcatccttttttctcccactacatgacttctccgctaacgctatggacaaaagaaagtagtgctagcttaccccggcaaatgtatgtcgtgatagaacgaaagcggatggatgtggcgtgctatgctcaagggaaactcttatttgtgaactcttacccgatcgaccaatcggacgatatagtatactatatattatatgtatggaaacaggcgggattggaccaagaaaaggaccagttgcttttagcgggggaatcttcctcgcaaatgcgggttctggagcgattgcgagcctatttacgccatgttaagccggtggagatcccttcggaagcctatttgctgggaacggatgtaacgaaagcccctatggatttaatatctttattaatatgcgaataataagcggtatatacggtcgtcggcgttttgacgtgccctcttcgtttagcgcacgtcctacgacggattttgcgaaagagaatatttttaacgtagtaaataatttggtggatctggaaggtatggatgcgttggatctttttgccggaaccggaagtatctcttttgagttgatctcacgaggatgccggaatgtaaccgccatagagaaaaataacgctcatgcctcttttatagccaaggtagcgaaagagctgaagacggatgcgttggctctgattcgtggggatgttttccgttatttgaattcagcccctaagcaaagtttcgatttcatctttgccgatcccccatatgccttgccggagttgccggaaatacccgccttggttttcgagcgtgatttactaaagaatggagggatattcatcatggaacatcctaagaccaatgacttctcatctttgccttatttttatcagcaccgggtgtatggctccgtgaactttagcatcttccttaaagaaggggagaaaacagacgcataaatgattccgccatgcgttgcttgagggggcgctttaaccagcgggaagggatcaaacgctcacagtgatgcatgtcgtgtgtaaagatgcgtttcatttgcagggcgaattccttttgatatacgaaagcgttaatctcgaagttatgctcaaagctacggaagtccatattggcggacccgatgcttgtcaatgcgtcgtcggacacgactagcttggaatgcaagaagcccggtttgtagaggtatacttttacgccggcctttaccatctcgtcgataaaggaatgactggccatattcgctgaacgtgtatcggaacgcttaggcagcatcaaacgaacatccactccccctaaggcggcggtttgcaacgcttggtttaatccttcggtaggcaggaaataaggggtttgtataaagatatacttcttggcgttggcgatcatgaaaatggtcgcttgcaacaaagttctccattgacctaccggaccgctagtggcgatttgcataatattatcgctatagatttcggcagccggatagtaaatccgatcgttcaagagttttttactaaccacgtaccaatcgatgaggaatacggattgaagcccgtgtactcctttccctacgaatttgaaatgcgtatccctccatgtgccccaagaggttcccttatcgtatcggtcggctatattcatgcctcccataaacccgactttaccgtctatcacgataatcttgcggtggttccggtaattcaccttactggtgaaaacggggaacgctaccctcaagaacgcatatacctcgatacccgcttccttcatttccttaaagaagccgtcttttacattccagcaacccacatcatcataaagtacacgtaccttcacgccttcttttactttcttgataaggagttgttgcacctgttttcctatctcgtcatcacagaatatataatattgtatatggatatggtgagtcgctttctggatctcttccagcaagtctttgaacttatcggtaccattcgtataaatcgtgatttgtgttccgtataggagggaggattggttggtgttagtcaacaaggtcgataaaggtttataggggtccggaactacgcaggcgtcttgaggtaatttaccctcttgcggccttttcatgatgcgtttataggtacgcctcgatatgatccgttgtttccggttatcttgtccaaagaagaaatagaaaagcagtccgataccgggtgctaataataagacgattacccaaggaattgtctttaacggattcctattctctgtaatgataactaataccagtcctaatatagtgacgctatacaatatgataaatatcgtaccaacgattaactgtatatgaatggctgctaacatgaaactctctctttgctataatctgctataatttgctaagataagaatgctttccgagaatagcaaatttccgtattttttttgggctgtatagaagggccaaaaagtaagctaacttaaatggcaaagtaagctaacttaaatgcccaagtaagttaacttactttgccaacgaagctagctgactttggaagcggggttatgtacattttaaaataatgaggttgttctctaaatataaagtgtcatttgttgattttggcgcaggctattatgagaagtatctatgataacaataaaaatatttagattgaaaacgactgtaaaaaacgatcgtttcaattattcgtttgcaaaggtaggcatttctccgagactggcaaccttttccgattaaattttgtcctgctatatatctttttctcaacaggatatattaatcaaagtgtcacgaatatgacaaaagagcatcatctttttgctttctaaaaaaatgcaagatctaaacgatcgttttcactagtcgttttttatgtggaagggtaagaataagaaaaacagtaaaccaatgataacttggaatcaaactctagagatatgaatagaaagtcttctatacgagccattttactccgtaaggaatgccttttattctttttgctactattgcctatgtttacaaaggcgcaatataataaggtatatgcggatatcaccgcgaatatgctggtcgatatgggttttgagaatgttatctggtcggaagacgagaaggagagagtatatgtcttggagaataccccttggcgtttgcagggtgtgggactggcccatgccatagaccgcatccagaaaacaggcttgccggagaagggcaaatcctgccgtatcgtcgtattggataataatataccgcagatctcattgatctatacggcaaatccggacagcttgaaggcggctcccggctcctatgcggcccgttccgcctgggatgctacttacgatctgggcgatagctgggataaggtgaaaaaagagtaccgtatgaatagctccttatttaaagtagacgtggtggtttatccagagttgtatctgaagaacctcattatcacgcaaatataccaagtattattcaacctctcgcctgcgatcgaggtctctttctggaatgggatgaagctgacggcgcagatggtatttcctatatataatgatggatatggtccttgggcgggtaagattcacccgggcatggttaccctttcccaatcttttcgtttaccttatcgtacgttcgccagagccagtatcggtttgttcaatgcggatcgttatggcgtggatttagcggtaacccatcatttgaaggatgaacgtttttctttggaaggacgtattggttgtacgggtacgggatcttggcagaagtttgaatatcattatggaactcaccaacgggtgacatggtcgctgggaggtagtttctactggccaaaatacaatacgcaagtctccttgaaagccgagcaatacttactgggtgagatcggaggacggattgacttgatccgccattttcgctattgttcgataggattttatgcgatgaaggcgcaaggtgctttgaaaaacggcggtttccggtttcaagtggctcttcctccttataaatataaacgtaagaatgtgcgggtgcttccttctgacaactggggtatgtcttacaacgccggtaatgaacgctattattataaggggtataaagcctcgccgaatgataacatcatgcaacagaatcaattcaacccgtactttataaagtcggaattactcaatttttaaatagttttattatgagaacaattacaaagttacagaccttattggtcttgttccttacgacagccatggtatgtttcatgggctgtaaggatgacgatgatgatgtgcctactccggatggtggtggcactgttgccacctatgcgattagtggtacggtcatggatgccagcaacaacccgatggctggcgttagcgtagctctttctggagctcaatctcttagtgctacgacgggttctgatggaacgtactctttcgacttgaaaagcacaccaggctcttacaaaatcgcctttaagtcggaaggctatgcagacagaagctatgatgtggatgtgaagaagatcgaatcgggtgttggacagtatgtagtaaacgccgtcatggtaaagggcacgactcccgatactccgaaagagtataagaaggcgaagtacaatctttccgtatcgatcgaggatgttgtgggaaaagctatctctacttccagcctttctgttgtcgtaaaatacggggataaagagatcgctaaagagaataaacctaattttaaggtctctgatgtgactcccggtatctacgacgtagtagctacagcttccggatatactaaagccgtggctaaggttgtcgtttcagccgttccggatcaagaaaagaaagagggcgaaggtgatacattcgacgttgagtatccagctattatcgtgatgaatgtcgctccttctattccagtagacccggatgatccttctaagccgacagatccttctgacccgtctgatccttccaagccaacagacccgtctgatccttccgatccttccaaaccgacagatccgtcaaaagcgacttatatcgtatctggtataataacagacctatctacgggcgcagacatcaaaacagcggaagtcacattgatgttaggaagtgaagagttatttatttctaagaatgagagtgagttctctttcaatatcgcatcatcaaaggttacggaggatgctcaatttatcttgagtgttaaagccgcaggttatacgagctactctcgtacgatcatctttaaggttggtcagagtatgaactatgtatttcctatcacattgaaccctgtaggtacaggtggaaatacggagattgatttttctaaatatggtgttcaggttccggaaaaagaagcggaaaaagtagcggatgagattaagaatgcgattaacgcaggcggaaccgaagaggttaaggtgtctggtgtcacttatgtggatgagaataatgttgagcaaaaagtagacgttgtcattcctgctaatgtcttagataactataaaggtgcggataatgaggttcaagctccagttattaaggtcttgaatcaaagtgatgctgagaaattgacagaatcgataggagtgattgaaagtacgaccgctgatggtataaaagagaaagatgaggtaagtttggtcgcggaaagtggtaagcctgtcgttatcgttatgccggcaagtagtaatcaaacattggtgatcgaacgtgatatgtctgcggaagctctgcaatccaataatgtgacttctgatgctggtgcggtagccagtgtaagccgtgtatataaaggcgagcctagcggtacggtattctctccggctttgaagatctcgttcgacgctccgaaggatttggtttcttctacacagcctatggcattgttatatgcgaccacaggcatagataataaggagatcatgaagattgatcctacggcggaccctgtttatatcaatggtactggtgcggaaatgtctgtcgctcacttctctaagtttgccgcaggttttgagttggcattagcggaaactgaagatatcagtactgatactacaatcgtagaaaaggttgttgactactgttctgatggtaaggcaggaaacattcctgtagttgttacaactacaaatgcttatgttggagaaaacttgcaggatctagtcggaaagtctaacgtagatggtcaagtcgctaagaatgcggtttataaccgaatctctaatcgtttgcaagctgatggttatcagattggtacccaaacatcattgactacatccgttcctacggaagctgatcgtacggtcgcttctatgagcttgaagaagacatatactacaaatacgtatgtatttaagtttatgacaaagggtaagaaggtggaagagattcaggttgtagctaaaaaacttatcaagatagaaggtactcctgtctacaagcaatcccacggtcacggacatggtgatggcaataacgccggtggcggtatcatcatcccggattaatgcttgatatttgaagcttgattaaataatgttgagccggaagtttataagtaaacaaagaaaaatgaagaaattactcttattaatcatattcttaagttgctggaccttacttccggctcaattatcttatggcacgacagggctattgcatgccccgtccgccgatatgcaaaaggacaagaccgtgatgcttggcggaaacttcttgcatcaagagcttacgcctcccaagtttaattttaatacgtggaattattatttgaacgtgacgatcttcccgtttctggaagtagcgtatacttgtacgctgtttacggccgagagccttggattggataagcatggctattccggattcacgaaccaagatcgttatttctccgcccgcttacgtgtgttgaaagaaagcaaatacatccccgctgtcgtgctggggacttcggacccttttacgtcatccgggcataaattcgcttcagccatagggaacggctatttctgccgttattatctggccgctaccaaacattttcagctgggaagggaaaccttaggcgttcatttatcctatctgtataaccgccgtgaggattatcccttgaacggtgtagcgggaggtatcacctacaatccttcattcgccccgcatttgaacgtcatagccgaatacgattcgaaagacttcgctatgggagccacttacctgctattcaatcatatacattttcaatttgaattgcagcgaatgaaatatttctccggtggactgtgctataagatttatttaaaataaaaagaggttcagcttttgtccgtttttaatccgcttggaggcgaacggttaggctgaacctttttatatcttgttacgctgtcgcgccagccatatctacggctttattccccgatgaaattcttgcgtatcaactcggcggacttgtactcctcttccagatacgtctcaatatgccgtttcttcttatcctctaatatctcgttaatagcgattaagatacccgtttcttccacctctccaaactcatggttgatcgctgtgccgaatacacgcatcttaggcgacaagctcatgtaagcatttaccaaaggaggcacgttgatgccgaatttacgaacctcttggttcaataccttgtagttatccttgaaattatcgtgagggaaaagagatctcatcttctctacatccatattagtctccaaaggatataccggagtgatcagttggtctgcgtccgggaaatgcaatccgaggaagtataagatcatattacgggcctcttggttgtacgtattgtacatagtcaccttcccgaaataatacctcaagctcggatcaaccacggataaagcccccaatccatcccacaggttatccaacacgaataagcctttcgccccggaacgggtggattgatactccagagccacgaacgagcgtcccaactctaccgtataaggaaggatctccttgataaatttctctgagaaattaaacaagtgcgaggtcgccaagatcggtttgccattctcgtcgaacttaacgtccgaaccacaaaggaaacggtatccccccaagatctgctcatcttccgggctccagacaatcagctggcggtaagcgtcttccatcgtgtcatactcatcgatatccacagggaatcccgtgccacccccgtaataacggaaagcgacctcccgcagacgccctatctcttgcatgacattgggtgagtcgtgcgccgtgacgatataaatctcattcttcgatttattggtacttctcaacctcttctctttggtcaattcagccttcagtagtgccctgtctatgggattgataatgtcttgcatatgtttcgtctgttaatccttgagtttgtaaaccttgttttttatccactcagcccattcggcgggtttcttgctattgtcgaatgtctgccaagggataggcttcccgaaataaatccggaaggtcttatgtttgctccggaacatctcgtccggtaaataaatcatctcataattcatctttatacccaacgccttgcgtatccgggcgaggttatagaagaaattggaattcttcccgtcgaaatagaccggtacgatatcccgcttgtattgcaccgccttctggatgaacgatttcttccactccaagtcttgtatcttgccaccaatcttgcgagagcataatccagcggggaaagtgatgatctggtcgtccgaggcaaaagcctcctccagcatccgtgcgttgtcctttccttgggtgccgtgtttgttgatcggtacaaagatggattttagattggagagataaagtaataaatcattgaccggatacttgatgcggccttcgaaccgggaaccgataacggcggagagacagataccgtccaatcctccgagcggatggttggaggcgaagatatagcgcccttcggtcgggatgttttcctcatgtaccagatcgagggtaaggtcaaaatagccgataagctcacgcatgaaatctaccccttccttatcgtggtaacgggttaatatatcattcagttcctcttgatgaaccgtgcgaatcaagtagtccacgataaatcccggaatcttgcgtgacgccttgggcgccttttgtgccaatacttgcttaatatctatctttgtcacaccttgttttgccatctatataagcttgtcaaggggcaaagataaagttaataattaaaacgagagaggtttgagtgaagtttttgctttttcgccagctatcttggccttttccccttgatcttttagccgctaccattagggaggttagtccccgggcgcttgactatcggttatctaacggctgttggacgatcatgcaccatctgttagaagatcatctaccaactgttgcatgatcgtccaacggccgttagaagatgaaggtgaaaggaagaattggttaacggataccggtgaaaagcgtaagagataaggacgaaaagacgaagggttaacgacctgttgataactttttcctacttttcttatataaatgttggcgggtaattttggaaatgtgtacttttacccaccgataaggcatgtgcgtgcgtatcaaaggagtacggcgctttattttaagaggaagtttaacgtaagaacgacgaatggaagaaaaagatagttgctatcatgtaccggtaatgctgcgggaaagtctggagggattggatatccgtcccgacgggatttacgtggatgttacgtttggcggtggaggacattcccgcgagatcttgaaacggttgggtagcgagggcgaactttacggctttgaccaagatgcggacgcggagcataatatcccggcagatccacgattcactttcgtgcgcagtaatttccgttatttgtataattttatgcgttactatggagaaagcggggaggtagacggtctgttggcggatttaggtgtctcttcccatcatttcgacgataaggatcgcggtttctctttccgtttcgacggggcgttggatatgcggatgaatacgcgtgcggggcagaccgccgctgatatcgtcaataattatacggcggaggcgttggccgatgtgttttatctatatggcgagctgaaggtgtcacggaaattagcctctgtgctggtgaaagcccgtgagacaaagaagatagagacgatcggggacttcttggaggtgatcaagccgtttacgggaaaggacaaggagaagaaattcttggcgcaagtctttcaagcgcttcgtatcgaggtgaacgatgagatgagggcgctgaaagagatgctgcggagtaccttgcgggtgttgagaccgggaggacgattggtggttatcacgtatcactccttggaagaccgtctggtaaagaactttttgaagaccggaaacttcgaggggaaatgcgagcaggatttcttcgggaacgtacgatcgcctttccgcttggtcaataataaggtaatcgtcccgaccgacgaggaggtggagcggaatccccgttcccggagcgccaagttgagaatcgctgagaaggtataaggagaaatagatatggaagaaaacggacaacataagaaaacgaggaagaaggagaagcgtctttcgttctggtatatactcggtggcggcgtgctgaaagaggattttatcttgaggcatacgcgcatgatcgtgttacttgtcgtgttggcgtttttctttatcggtaaccggtatacttgtatgcaaaagctgcgtgagatcgaccggttgcaacagcaattgagggatgtgcgtttcgaggcgttgtcgatctcatccgagttgaccggcaatagccgccaatcgcaaatcgagttgctgatcgaggagcaaggtattgatctggagggtgcgaaaacccctccttatgagttatataagtgagataaggtgtaaataggtatgtctgaagaaaacgaaccgaaagaaatagagcctaaaggtagccggattttattctgttacttcgtggtcgtgctgttgctggggcttgtggccgtaggaatcctgttccgtgcctttgatacggccttcgtggagagggataaatggatgaaggtggccgagagccagaaacgaccgaaccgtttggtgttgcccggacgtggcaatatctattcgtcggacggtaagttgatggctaccagcgtgcctcgttattatatgtatatcgactttaaggcggatgcgtatactccggctaaggatgccaagtataattggctggatacgttcaagacgtccaagaaggatggggtggactcgttggcgttttatctttcccgtaaattgaaggatcgtacgccggcgggctataaggcttatctgctgaaagggctgagcggtaaaagccgccagttcccgatttacgcggggaaggtctcgtattcggacttgaaggagatccgtaagttcccgttccttcgtctgggacgttataagagcggtttttatacgaaggagatggtgcagcgccagaaacctttcgggaccttggcgtctcgtacgatcggtgatatctacggagagatcgaggagggtggaactacgaaggggaagaatggattggagttgcaatacgattcgctcctgcgggggcaggccgggttgagttccgttcgccgtgtcggtggaggctggacgaacgtgattgaggtggacccggtggatggcatggatattcgcaccacgatcgatatcaatatacaggatataaccgagaaatcgctggtcgataaattgaaggcgatcgatgccgagtctggtacggctgtcgtgatggaggtcgagaccggagagatcaaggcgatcacgaatatggggcgtatccgtgagggcgtatatggcgagacgaagaaccatgccgtggcggacgagatcgagccgggctctactttcaaggtggcctctatcatggtggccttggaggatggtttatgcaatccgggagatacggtcgatgtaggcaatggtatatatatgtataagggggcccgcatgacggaccataatatgaataaaggcggatacggtcggatctcggtggagcaggcgatttggtattcctccaatatcggtgtggccaagacgatcctgaaaggttattcggataacccgacaaagttcgtggagggactgtaccgtatcggtatgaacgcggatcttcgtttggagataccgggggcgggacgtgccaagatacgtcgtccggatgatacgacccgttattggtccaagaccactttgccttggatgtcgttcggttacgagacgcaggtaccgccgatcaatacgttggcgttctttaatgcgatcgcgaacgacgggaagatggttcgcccgatgtttacgaaagagatcttacataacggcaagaccgtgcagagtttttccacggaggtgatcaactcttcgatctgctcggatcatacgctggcgttgataaaagatatgttgctgggagtcgtggagaaagggaccggtaaggcggttcattcggatattgtccggatcgccggaaagaccggtacggcgcagatcgctacgggcggtgtctaccgtacgagcgggcaccaagtctctttctgtggctatttcccggccgatcatccgaagtattcttgtatcgtggtgatccgccgtccccgtattggttatccttcgggcggtacgatgtcgggaggcgtggtgcgtgcgatcgccgagaagatatacgccagccatatgtcgttcgatgtccgggatatggaacgggattcgatggccgtgatggtacctcgtgtgaaaggcggcgatctgagggcggtagaggacgtattagatgaattggatattaaggcggatacggacagtttggagacaaagtgggtcgtagcctccgccgagcaagaagagaataaggtgaaattaagcgatctgacgattcgtgagggcctggtaccccgggtagtcggcatgggtgctaaagatgcggttttcttgttggagcaagccggtctgcgtgtctctttgtcgggtgtcggacgggtcgtttcgcagagtattcaacccggacagcgagtgtctaaggggcagaccgtattattaacattgaaataggtatggaactaagggatttaatcggtgcgttggaagctcctatgttgatgggggcggataatgtggatatcacgaatattcaatcagactctcgtcgggtgacgaaagggtctttgtttgtcgctgtgagaggtacggccgtggatggccatgcctatatggacagcgccatagagaagggggctgtcgctatcgtatgcgaggaggctccgtcctatttggaggggagatgctcgtttatcgtggtgaaggattcggcggaggcgctgggtcttttggtttcccgctggtatggtgatccttccgggaaattggtgttggtaggcgtgacgggtacgaacgggaagactacgatcgctaccttattatatgagatgttccggaagatggggcataaggtgggattgctttccacggtatgtaattatatagatggcgaggcggtaccgacggatcatacgacaccggacccgcttacgcttcattccttgatggcccggatggtagaggccggatgcgagtatgcttttatggaggttagctctcattcgatcgatcagcggcgcatcagcggcttgtctttcgacggggggattttcacgaacctgacccgcgatcatttggattaccataagaccgtggagaattacttgaaagcgaagaagaaattcttcgatgacctgcctgccgggactttcgccttgacgaatgccgatgataaatccggcttggtgatgttgcagaatacgaaggcgaaaaagctgacctattccttgcgtaccttggccgatttcaagggaaagatattggaatctcatttcgagggtacagacttgatcattaacggtcgggaggttatggtgcatttcgtgggacgtttcaacgcttataacttgctggccgtgtacggagccgcggtttctttggggaaagatcccgaggaggtgttgatcgtgctgagcacgcttcgctccgtatccggtcgcttcgagacgatccagtctccgctcggttatacggcgatcgtggattacgctcacacgccggatgccttgacgaatgtactgaatggcattcatgaggtattggatgggaaaggacgtatcattaccgtggtaggtgccgggggaaaccgggacaaggggaaacgcccgctgatggcgaaagaggctgtcaagctgagcgatcaggtaattctgacttccgataacccgcgctttgaggaaccggatgatattattaacgatatggtagccggattgacgaaaatggatatggaacgtaccttatgtatcacggaccgtacgcaagcgatcaagaccgctacgatgttggcgaagaaaggggatgtgatccttgttgccggaaaaggccacgaagactatcaggagatcaagggggtgaaacatcactttgacgaccgtgagaagttacgcgagattttttcgacacaacaatcataatatttaagacgacatgctttattatctttttaattatttggatcagttggatttcccgggagcgggtatgtttaagtacgtatctttccgctcggggttggccttgatcttgtccttgtttatctctacggcgatcggccggcgtatcatcgataagttgcaaatgttgcagatcggcgagacggtgagaaatcttgggctggagggccagatgagcaagaagggaacgccaacgatgggaggtattatcattattatcgctatattgatcccgactttactgtgtgccaagctgaataatatctatgtgatattgatgttggtgactacggtttggctgggagccttgggattcgcggatgattatatcaaggtgttcaagaagaataaggagggcatgcacggacgtttcaagatcgtcgggcaggtaggactgggcctgatcgttggcttggtattgttcatgagcccggatgtggtgatcaaggagaatatggaggtgcgccatgataacgtgatcgaggaggtgcgttatcatacggtggagaccaagtcgacaaagacgaccatcccgttcttgaaaaacaataatttcgattacgccaacttggtgaactgggcgggcgattataaggaggaggccgcgtggctagtgttcgtgctgatggtgatctttgtggtgactgccgtgtcgaacggagccaatatgacggatggattggacggcttggctgccgggacatcggcgatcatcggggtggcgctcggtattttggcctatatgtcatcccactttgagttcgcctcgttcttgaatatcatgtttatacccggcgcggaggagttggtggtttatgccgctgcctttatcggtgccacggtcggtttcttatggtacaactcgtatccggcccaagtatttatgggagatacgggtagcttgaccttgggaggtattatcgccgttttcgcgatcatcatccgtaaggagttgttgattccgatcctttgcggtattttcttggtggagaatatatcggtcatgttgcaagtggcctactttaaatatacgaagaagaagtatggggaaggtcgccgtatcttcaagatggctcctttacaccatcatttccagaaaccgggaaacgcgggtatacaggcattgatccaaaagccgttcaatgtcgtgcctgaatcgaagatcgtggtccgtttctggttgatcggtattattttggctgttatgacgatagttacgttaaagatgagataaaagatgagtaagagaatggttatattaggggccggggagagtggcgcgggagccgctgtcttggcgaaggcgaaaggattcgacgtgttcgtgtccgataaatcgtctatcaaacctaagtataaggagatgctggacaaccacgggattcgttgggaagagggacagcataccgaagccgacatcttgagtgccgacgaaattgtcaagagcccgggtattcccgacaaggctcctatcatacagttattgaagaagcaaggtacgccgatcatctccgagatcgagtttgccggaaggtatacggactcgaagatgatttgcatcacgggtagcaacggcaagacgacaacgacgatgcttacgtatcatatactgaaagaagcgggcgtggacgtgggcttggccggaaatgtcggaaacagcttggcgcttcaggttgcggaagatccacatgcggtctacgtgatcgagttgagcagtttccaactggataatatgtacgactttagagcggatatcgctattatattgaatataacaccggatcatctggaccgttataactatgagatgcagaattatgtagacgctaagttccgcatcttgcaaaatcagacgaaggacgacgccttcattttctggaacgatgacccgatcatagcccgtgagatcgccaaacggcatcctgaggctactctttacccattcgccgagacacatgagaacggcgtgaagggatatacggaaaataatcaagtagttattgaaacggcaaacggaacatttacgatggaacaagacctattggcattgactggtacgcataacctgtataactctttggcttcggggatagcgtccaagatcgtggacattcatgatgagaaaatacgtgcctcactcagtgatttcacgggtgttgagcaccgtttggaaaaggtgcttcgcgtgcgtggtgttgattatatcaatgactcgaaagctacgaacgtaaactcttgttggtatgccttgcagagcatgacgactccggtcgttttgatcttagggggcacggataaagggaatgattactcggagatcgaggaattagtgaataagaaggtacattcattgattttcatgggtgtggataatacgaaactgcatgcgttcttcgacgggaaagtggcgaatattgaagacgcccgctcgatggaggaggctgtggcgaaagcttataagatggctcataagggagatacggtattgctctctccttgttgcgccagcttcgacctgttcaagagctatgaggatcggggcgatcagttcaaggcttgcgtacgtaatttgtaataaaggataaaatggatctggcgagtaaactgtttaagggcgaccgggtgatatggatcatcttcatgttcctgtgtcttatatcggtggtggaggtgttcagtgcgaccagtacgatcgcttataagaacgcgaatcactgggcgcctatcgtacggcacgccacctttttattgggaggtttcgtcatggtattgctgttgcataatataccgtgtcgcttcttttctgcgtttattatattattgccggtctcgatgttgatgttgatcgtgacgccctttatcggcgtggacgctaatgatgcgcatcgatggctggaaatcatgggaatacagttccagccttcggagttcgggaagctggcttgtgtcgtgtttgtcgctttcttgctcagcaaacgggggaaattaacggagaaccagatctttaagtatatactgattggagtaggactgacctgtgtcttgattctgccggagaacttctctacggcgtttatgttatttggagtttgtttcctgatgatgtttatcggtcagttgccatttggtaagttggcgaagctggcgggtatcttgatgttggcgttggtattgttcttggcgttgcttaagtttacgccggccgctattacccagtatttgccggatcgattcgttacttggcaggggcgtttggagcgtttcttcgacgggcataaggataatttggatgagagtggtacgtataagataaccgatgataattatcaggtaacccatgcgaagatagctattgctaggggaggcgtattaggacagatgcccggacatggccaacagcgtgacttcctgccacaggcgtattcagattttatctatgcgattatcatagaggaactgggtatcgttggggggatctttgtactgttgctttatataatgctgctagtgcgggtcgggatgatcgcccggaaatgtgataaatcattcccgaaattcctagtgttgggatgtgggttgctggtggtagtccaagccttggcgaatatggcggtagccgtgaatttagtgcccgttaccgggcaaccgatgccgttggtgagccgggggggtacgtctacgcttatatcttgtatctatttcgggatcatattgagcgtaagtcgttttggagccaatatcggaaatgaggatgaggaagaggaggatacggagaatccagagaatccttccgacgagccatccggagagacaataaatcaggcggtcgagggagagaaagaagataatccgctatcggctgtcgaaacgataactgtagagtcaaaagtatgagaaagtaccggatcataataagtggtggtggtacgggaggccatatcttcccggccatatctatcgctaatactttcaagaaacgttttccggatgcggaaatcttatttgtgggtgcggaagaccgcatggaaatggataaggttccggcagctggttataaaatcgtaggtttaccagtgagtgggtttgatcgtgcccacttgatgaacaacgtgaaggtcatggctcgtttagcgaaaagcttgcgcttggcgaggaagacgatccgtgagttcaagccagatatagcggtcggcgtgggcggttatgccagtggaccgactttatggatggcggcttcgcaaggtgttcctgcgttgatacaggagcaaaactcgtatgccggtgtgaccaataagttgttggcgaagaaagcgagcaagatttgtgtcgcttacgagggcatggagaagttctttccggcggataagatcgtgattacgggaaatccggtgcgacaggatttggaagaggcgctgagcaagaaagaggaggcgttggcgttcttcgggctttctccggagaaaaaaacgatccttgtggtaggtggtagccttggcgcacggacgattaaccggagtattcaaggggatctggataagttcttcgcctcggatgtacaggttatttggcaaaccggtaggtattattacagcgacgcttccaagcatttgaaggcgtaccggggaatgccggtttggtgctcagactttattacccgtatggattatgcttattcagcggccgatttggtgatatcccgtgcgggggctagttctatctcggagctttgcttattaggaaaaccggtggtcttggtgccttcgccgaatgtggcggaagatcatcagaccaagaatgccttggccttggtccataaggatgccgccgttatgatcgccgataaagacgcggaaaaggatttggtgcctactgccttgaagatagttcatgacgatgaacgtttgcgtacgttgagccgtaatatcgagaccttggcgcaacgccatagcgcagaccgtatcgtggatgagattgttaagattatagataagaaataaggaatatggatataaataaagtgacagcggtgtatttcgtaggtgccgggggcattgggatgagtgccttgatccgttatttcctcgctaagggaaaacgagtgggcggatacgataagaccccttccgatttaaccgaggagttgaaaaaggagggagccgatattcactatgaggataatgtagctttgatcggggaggcgttcaagtcgcccgatgatacgctggtggtttatacgccggcggtcccggagtcgcatacggaattgacctatttccgggcgcacggttttgaggtgatgaagcgggcacgtgtcttgggagagattacgaaaagcagccggggtttatgcgtggcgggaacgcacggcaagacaacgacctcttctatgctggctcatttgctgaaacaatcgccggtggattgcaatgctttcctcggaggaatcctaaagaactacgagagtaatttgatgttgtctgatacgagcgactttaccgtgatcgaggcggatgagttcgatcgttcttttcattggcttactccttatatggcagtgattacttccgcagatccagatcatctggatatttacggtacggcggaggcttaccgggagagtttcgagaaatttacctccttaattcgtcccgatggttgtctactgatcaagaaaggaatcaacgtaacgccccgtttacaggagggtgtcaaggaatatacctattccgttacggaaatagcggacttttacgctgaaaatattcgtatttgcgacggaaatattacctttgacttcgttggtccagaaatccgtattcctgatgtggaattaggtgttcccgtaaaggttaatatagagaacggggtagcggctatggcgatcgcttggttgaacggagtgaaaccggaggatttgaaaaagggtatagctacatttgccggacctcgccgccgtttcgatttccatttgaagactgatcaagtggtattgatcgatgattatgcccatcatccggccgaattgcgacagagtatcttgtcggtgaaggaattatatgcgggtcgtaaggtgacaggtattttccagccgcatctatatacccgtacccgggatttcgctggtgatttcgccgcgagtctctctttattggatgagttgatcttgctggatatctatccggctcgtgaggaaccgattccgggggtgagctctcggatcatttttgataaggtgacgatcccttccaagacgctgtgtaagaaggaagagcttttggacgtggttgccgccgggaaatatgaggtagtattaatggtaggcgccggtaatatcgaccgtttggtggagcctgtaaaagagattttatgtaaacaaataaggaaaccgtgatccgaataatttccatagtagtagccacgttgttgttctgttacatcgtgtttgtgtcgtttttctttcgggaaatacgtcaggactctatttgccaagatctgcaagtcgtggtgaaagacagtctggataaacacttcgtgagcgagagtgaccttgtgtctatactgaagaaagccgggctagatccgatcaagcggtcaatggccgacgtgaatacggatcggatagagacggaattgcttaagaatgagatgatcgcccaagtggaggcgtataagactccttcgggtattatcaagctagaggtcatgcaaaagatgcctatcctccggattatgggcgtaagaggtagttattacgtggataatctgggaaccaccatgccgatcagtcgtcggtatgccgcacatgtgccaattgtgagtggatatgtggaaaaagagcttgcggtgaccgacttatacaaatttgcattatttttgcaagagaatgagttctggaatgaccagattgaacaaatctatgtctatccggataatgatatagaacttattccaagagtgggtaaccaccggatcatgttgggtactttggatgaattcgaagaaaagcttgcgaatttaaagcttttctatgaacaagcgatccctaaagtgggttgggaaaagtacagtatgattaatttaaaatataagaatcagattgtttgtactaaaaaatagatgatatggcatacacagactttatagcagctattgacctaggtacctcccatatggtaggaatggtggggactaagaatgcgacgggcgctctttcaatcatcgcctacgaagttgagaactccggcacctgcatacgaagaggatgtgtatataacgtgaaggagacggcgagtaagataaaacgcttgatcctcaagttggagaataaactgggggggaccaagatcgggcaggtatatgtgggactgggtggccagtcactccgttctatcgagcatacggtttgcaaggtgttgggaacggaaggagtggttacggaggagatcatagactctctttatcaagagtgtaaggattatcgtccggatatgttgaccgttcttgacgtggtttctccttcctattttttagatgataaaccagagtccaacccggtgggcgtgccttgtagccgtatcgaggctcgttataagttgattgttggacgtccttccttgaaattaaatattgtcaatagcatctcggaacaagcgaaaatcgagatcgccggtattctggtgtcaccccttgcgttgggagatgttgtcttgagcgacaatgagaaggacttgggttgcgccttgatcggtttcggtgccggcgtgacgacgatatctgtctataagggtggtaagttggccagcctttccgttgttccctttggaggtaatttgataacaaaagatataaccaatctcagggtcgtagagtctgaggcggaacgcttgaagatcacttatggtagcgcgaaagcggaccgggataatgatatgaccatccaagtgagtttagcggatggaatgggcttgcgtgagattaagctggccgagttgaacggtgtgatcgaggcccgtatggatgagatcttagagaatgtatatgctcgtctggaggctacaggcttgatgagcgttctcggtgctggcatcgtgattacgggtggaggcgccgctttgaagaatttaccggctgttatgagcgaacgcttgaagatggaggttcgctattctgcggttcgcaagggggttgtcgctagtggtgatttagtggtcgccagcaatcccgaatatgcggtagccgtcggcctcttggcgaaaggaactaagaattgcgcgttatatattcctcctaaaccggagcctaagattgagccggtggttgagcctgaaccgatagtggaaccgactccggaaccggaacccgtcaaggagaagccgaagaaagagaagaaaaaaggtcccggcttgttcgggcggttgacaaaaggaatcgatacctttggtaaaaccctcttcgatgacgatgataacgagagtaaataacgtgatctacgaatgtaataaaaccggaagacaatggacgatacaatattaaattttaattatcctacggatactcccaaaatcattaaggtgattggtgttggaggcggtggcggaaacgctgttactcatatgtataaggagggcatacacgatgttacattcgtgttatgtaatacggataatcaagccttgaaccgttcggatgttcctatcaagttgttgctgggacgtgagatcacgcagggattgggcgcgggaaataagccggaacgtgcgatgatggcggccgaggagagtctggacgatcttcgaggtatgttgaacgacggtacgaagatggtatttattaccgccggtatgggtggtggtaccggtacgggtgccgctccggttatcgctcgtatcgcgaaggatatgggaatattgacggtaggtatcgtaaccattcctttcttgttcgagggtgagcgtaagattatacaggccttgaatggtgtggaggagatcgcgaagaacgtggatgccttattggtaatcaataacgagcgtttgcgtgagatttattcggacctttccgtgatgaacgctttcggcaaggccgatgataccttgacgatcgccgccaagagtatcgcggagatcattacgcttccgggtattatcaacctcgacttcgccgatgttaacaccacgatgaaagatggtggtgtcgctttgatgagtaatggttttggtgaaggagaaggacgtgttcgccaagcggtggaagacgctctgaattctccgctattaagcaacaacgacgtaaagaacgccaagaaaatcctgttcaacgtatatttcagcgaggaagccgagttgcgcatggaggagatgaacgacgtgcataactttatgtccgagttcaaccgtgatatagaggttatctggggtactgccgtggataatacattaggtaataaagtgaaaatgacgatcctcgctactggatttacgatggatgatattccattgatcgctgataaacgcaggaatgaagccgctcagatgacggaagaagaattgcgcttagaagaagagcgaatcgagaaagagcgtaaggagcgtgatttgattggtaaatattatggtgcttccgcacaaaaggtgggtcgttttacctctcgtgcgaaagcggtagttttgactcaggaagagttggacgatgatgccttgatcgctttgatagaggataatccgacttataaccgggatccgaagatcgtagcccgtgcccgttccaaagtagcgggagaggatattcaagtatcggctccgacaacggcgaagcaaccggctaaccaatctcgccaagattctcagcgggggggtaaacaagtgatcagtttccgatagttaataatataataaggatatggatttatttgaacaagtcagtgaagacattaaaaacgctatgaaggcgaaagataaagtcgccttggagacattgagaaatgtaaagaaatttttcttggaagcgaaaaccgctccgggagccaatgatacgctgacggatgcggatgccttgaagatcatgcagaagttggtgaaacaagggaaagattccgctacgatttatgtgcaacagggccgtcaagacctagcggatgttgagttggagcaagtaaaagtgattgagaaatatttacctcaacaaatgtctgccgaggaattggagaaagaattgaaagctattatcgctcaagtcggtgccgctggcccgaaagatatgggtaaggtaatgggtgtagcctcaaaagcattggcaggaagagccgaaggacggatgatttccgagacggttaagcgtttacttaattaattgattcatacgaagactgcactaagggcattctgacaattactcgttagaatgcccttggtacggttttctcgtatataccttttcctttgacaatttaattctttagaaaaccatgattacttttacatgttgtctgatagcccttatcgttggatattttatgtatggtaaatttgtcgagcgggtgtttggcgtagatccctcccgggttactcccgctttcacaaaacaagatggtgttgattatatacccttgcctacttggaagattttcatgatccaatttttgaatatagcgggtctgggacctattttcggcgctatcatgggggctaaatttggggtagcttctttcctttggatcgtattgggaagtatatttgcgggcgctacccatgatttcctatcgggaatgctttcgttgcggcatgatggagaaagtcttcctgaattgatcggacggtatctggggaacaactttaagcaatttatgcggggctttacggttatcttgatgatcttggtgggtgctgttttcgtagctgggcctgcagggttgctggctaaactgactccggaatatctagatgctacgttctggattatcgtcgtattcatttattatatactggctactctattacctgttgataagattatcggaaagatctatccattattcgccatcgctttgctatttatggccgtaggtatcttggttatgttatttattaaccagccgccgttacctgagattacggatggacttagtaatatgcatccgggaggcttgcctatttttccgatcatgtttgttagtatcgcttgtggcgctatctctggctttcatgctacccaaagtccattgatggcccgttgcatgaaaagtgagaaatacgcccgtcccgtattttacggagcgatgattaccgaaggtatcgtagccttgatctgggccgccgccgctacgtatttcttccataataacggaatggaggagaacaatgccgctgtcgtagtagacagtatcacaaaagagtggctgggcgctgtcggaggtgtattagcgatactgggtgtgatagcagctccgattacttctggcgatacggctttccgctcggctcgtctgattgtcgcagacttcctgcatatggagcaaaaaacggtggtcaaacgtctgatgatctgtattcccatgtttatcgttgcgataggaatcttattatatagtcaaaaagataaggatggcttcgatatgatctggcgttatttcgcatggagtaaccagacgttggcagtatttaccctatgggccttaaccgtatatttggtacaagcaaagaaattatatgtgataaccttgattcccgccttattcatgacggcggtatgttctacctatatttttgtagctccggaagggtttggtctttcctccggtttttctcaacttttggggctactagttacattgatcgttttcgggatcttcttagtctggaaaagaaagaaagtataaaaaaggctggcttacatttagccagccttttctgtcgttattgttcaagtgaattaaagcacttgtatgccttcctcacgggcttgttcctccccggaaggagtgattaatttataacccttgccgtggatgttgatgatctcgatacccggatcgtctttcaacaatttacgtaatttcgtgatataaacgtccatgctacgagcgttgaaatagttatcgtctacccagattgtcttcaaggcgtagttacgctcaaggatctcatttgcgtgggcgcacaacaaacttaataattcgcattccttcgtagtaagtttcgtaaccttgtcgccgatagccaacgtttgtttttgggtatcgaacaagaagtttcctaacttgtagaaaggaatatctttcatcttcttacctttcacacggcgaaggatagcctcgatacgaagcaatagctcttccatgctaaacggttttgtcaagtagtcatccgcaccgatcttgaatccttccaagatgtcttccttcatagtcttggctgtaaggaagataatagggatatcaggattgatagagcgaatttcttgtgccaaggtgaaaccatctttctttggcatcatgacatccaacacacaaagatcgtatttacctttggtaaaacctttgtatccggcttctccgtcagagaataggtccgttacataccctttagcttgtaagtattctcttaaaagcattcctaaattctcatcgtcttcacaaaagaagatctttagtttttcttccataactaactttttataagaggtaaagtaataataaattttgttccaatgtttccggcaccactttcagcacggatcgtacctttgtggtcctcaataattttgcgtacgtaagcgagtccgaggccgaaccctttcacgtcatgtacgttgcctgtcggtacgcggaagaaacggtcgaatacctttttcagatattctttcttgataccgataccattatcttccacggagatcaacagctttccgttctcgttccaagtgcgtgccatcaatgtaagcggaacttccgggcggcggtatttaaccgcattgtccatcaagttgaacaatacattggtgatatgcatttcatccacatatatatccgattctgtagcttgcaggtctatatccattgtaccgccgtacttctcgacctttaaaacgaaggtgttagccacgttcgctaccaaatcattcgcgtcaatttctttcaatttaagcgctgctttctgtcgttcgaacaaagacatctgtagcactttctcgaccaagaagctcaatcgcttcgtctcgtcgttgattacgccggatatatgcttgaatacgtccggactcttcgttatatccgaatccttcaacatctgagcggcgagcgagatcgtggataccggtgtcttcaactcgtgcgtcatgttgttgataaagtcgtttttcatctcggataacttcttctgacggaatacgatgtaaatcgtgaagacgaaggttatcaacaggatcaatgagaatataaccgatggaacgatgaaagtaatagagcttgagatataatcccctttcgtcggaaaataaactctcaggtagtttagtttcgatgggggatcgttcgggaaaagcacttgggtgatcacgtcagaggcgatcggttgcttttggaattctccgctctggtatactacatttccatctttgttaataacagaaaacacaaacggcaagttcaaaccgttgttaataaattctgtttttaagtaattgttcagctttttaaaatctatacgttcctcgatcggctttagattcgcggtgtataagatgttgtaaatcacctcctctatcagtccaccttggtactggtaacgtctttttagtgtcttctgtaaatctttagatgtgtttacgatgctgttggcagactgccgttttgacaaggaagagagcggctcgaacttatgggcgctaaaactttgcatctctatttgttgaacggttccattagaatccttgatctgtaattggtatttctcatggttgatcacttgtcctaggctttgggcatccggggcattttgatacatgaaatttgtctcatcccggttgatatcatcctcgaggtatttacgggtctcatccaattccagattcttagatacttggcgcaggcttcttttgacagtctcattgaactgttcgctgcgtgtcttaagtataatgctcacatagtttacctgtaggtataataacccggcgaaggcaaaagccataactaccgcaagcaaccaaattgtcgacttcctcatatcaatatctttctcttaatattgcaacaaataacgtatgttttagtttaatatttacacaaaaaaggtaaaaataatccgtttaaaatgttaataatactttgtggacatagaggatgtatgctagctaagcattgaaactccgctgttaatgcgctagttagcgttattttatcctaagttttttatatattatcctacgtaaaaacaagtccggtgcgttctttgttgcgcccggactttataaagtctccacttaggggattaaaatcgatgtcccggaggaggacccatcggacctcttccccgtccgcttctacccggcgttttcacgtcgctggcactggctccgcctttgaagatgctaaaccgatagatgaagtgtaccatgaaataactgcctagcgtgttatattctgagtcttgtatatagctagcggtaacggaacgggagatattgcttcgttgttgcaggatatcgtagatcttgaaacggagcgtcccttggttattctttaagaaagacttggaggctgaggcattccataggacttcgttctgtttgaatccgtccccgtagccagagttggtagaccagttcacgtcactctctatcttgaaattgaggggcagatagattgtcgtgtaaccgccggctccgtaattgaaggtgttttggttattttccttttgcagggagttgctggtggcattgtaacgaatattcccgtttacgcccagatccagataagaggagcggaagtcgataccaccacgttcggacaatatgagattccggttcgtattcttctcctcgttgatatatccgttgctattagcgaacgaggccattgtcatggagttgatggagaatttcttattcttcaagggggtgttcaacatcatacggacgttgccactatagttgccatttacgtttttgtaagtggtggtctttacacctgtctcttggttataagaggtataacttacgatatcgttgatgatataactaccgtttgccatgatcatgaaggcccgttgtttctccggcgtgaactgttggaaacgaataaatacgttgttcgtatagcggggattcaaatccgggttaccgatcgtgatattcgtcgggtccgagatatccgctaccggttgtaattgagtcatgctcggttggctggtacggccattatacatgatacgaagattcgtacgcttatcgaacatatagttgaattgagccatcggggagaggttgaccaccttacgggttatcttggataaggtcgtgtcgccaacgaaattctcgctgctggaataggatgggtccagattcaagccgatcgtgtagttgaactttgcccgttgagacttgaagctcaagctggcccgctggctgataaagttattgcgatagctttggctgtaggcggaatctaatacattatatataccatcagcgtcttggttgtaaacattcttcaaggcttcttgtttccgttggctgatgctataagtggcttggatgaaattattatgcccgatcggttctacccacgatacgtaggcccggtaattgaaacctttgttgtcgtaacgtgagcgctggtcgataatgctattcttcaaggcatcagtctggttgaaataaacgatgtcggaacggttcatgccgtcactgtacgaatcgctattgcctccggaaagggtggcgctgaacacacgccctttgttattcagcttacggctgaaatcgatgctggcatttaggttgtacccgttactttccgagtaattgttggatttgttggtattgaccgtatcccgttcgttatccaaggtggtagcatcactgaaattgtcattcatgctatggctgaggctgaaactcgggcggaagataagttgagtcatcgtgtccggtttccattccaagcgaaagtctacgccaaagttatcgctcttcgtacggctcatcgcctcgctattatcgtaggaggaactatctccgggaagaatattctgccggtcgctcttgctacgagcgtcattgtcggaatgggaataacgagtatttcccccaagagttagtttatccggcttgaattccttgctgaaattcaaacctgcgtttccggaagaggtgataccgctacccgctccgaaacctcctcgtcggcctccaccgcctcccataccggagaacattgttgaggctagatcggaaaagcccatattattcgtgttattcgctccccccatgaacgtgatctggtcattattcacgaaacgattgaccatggcgttgccttcataccgatctttacttccgtatccgccatatgcgttgccaaaccaaccttgcttcatgccgggtttcacggttaggttgatgacggtctcttcctctccatcgtcgaagccagtcatttgggccatatcgctttttttatcaagtacctgtaatttatcgatcatcttggctggaagattcttggaggccactttcgggtcatcggagaagaactcctttccgtccaccattacctttttcacctcttttccattgacggtgatcttgccttcgctatctacctccacaccgggcatctttttcaataaatcctccaaaacggagccttcggttactttataagaatccgcgttgtattccacagtgtcgttgcgaacggtaacctcgggtgccttacctataactacggcttctcccaactcgatcgctccgtcgcttaattcaagtttacctacgtttacggggtttttctttccggtgatttgcaagggttggtacaatggatcgtatccgatgaatgtgatgtgtagtaaataacttcctttctttacgtttttcaaggtaaaactaccattatgggcgctcaccacacctcgtaccatggcactgtcttttacgttcagcaatcgtaccgttgcttgctcgatgggggtatcactaccttgctcaacgacagatccggtaacattaacaccgctttgctgtgcgaaagccatcggtgaaaaaaggatcatcaacaacatcaaaaggcactttcccgatttcataactatatggattacattgtttacaattacgaaaagatagacaaggttcactcaaaatagtttaatataatttttatggatttgatattattaacaatcgtgcaggcctttggatttatggagagtattcttagaacaagaacattataaaaggtaaatagtccttcaatttaacccgcaatattttcaaggattgtgtaatccggtattccacggttttgatagaaacccccaaggcctctgcgatttggggattagattgctctccgaatcggctaagtttaaatgtctcccggtaattctcaggcaattcttcgatcgctttcgtgatattctctgtaagctcgttaacgaaataggtatcaggattctcaaattgatctttaatcttatcataaatcaggctatgtactcgctcatgatacaattgccttttgatcgcattgaggcaacgatgcttaacagccataaaaagataggatttcaaggatatctctacaaataaggaatttcggttttcccatataaataacattagctcctgaataagttcttcggcatcctcatcagaaacatattgggaagcatattcgcatagcggcgaataaaatttgataaacatctgtttaaaagcgtctttacttcctaattgtatttgttcaattaaagtagaatcatccatagcaccttcttcatcctttcttttctgtaagcaaagatatattttatcttggatattcaagattaaaattagggtaaccgcatcgaaatatcacttttaggacatccttatcgcaagatatacttactttaccgatgaagtactacttactttactgataaagtatatatcctatgggaaagtaagtagtaaaagtgactatgcctaaatttacttcacagattttactgttattttctaaggtacttcacatcttagagaagcttctcctgaaaaacttcacagggttgaaagttgtttcctgaaccggttcacagcggcaaaaataccgtttttctttttccatgcaaaacaaccatgaaaaaaccactgcggaggaagcctcgcggctggaggcgcaaagcctccattgagcgatcacatacaagtcagagcttctcggaacctgacaggtgggagcatgtccctgttgctcctatgcggtctcctattgttgtagaagtctatgatcctcgccaacaaatcccttgcgaccaccacgtccggggggcgtttcatcctgtagagccattcctgcttgatgatgccgttgacccgctcggcgatcgcgttgtcggtaggcttgtagtcctccgtcatgctgatcgtggctttaatggcctgtagacgatcaatatattgattacaacaatattgaacgccgcggtcggagtggtggatcagtccatcgaaccctaggggtgacacgtgcgagatacccatgtccagagccgtcacggtattggaggcgactaggctgtcggaaaggacccagcctatgatctcatgcgtgaacgcgtccgtcaggagatgcaggtaggccacgccctcatcggtgtcgatataggtgatgtcggccacccacaattggttgatcctgttgacggtcaatcccttgatcatgttcttgtacttcctgtaaggatggttggagcttgtcgtgtgacggcgcttcccgggcttcagcatcaggtgtgactcgtgcatcagcccgtagaaccagtcccggccacgcatctcgtccggatagagttccttgagcatcaggtacagcttgtacgccccgatgcccggagcctcatgccggatatccctcacggtgtcaagtatctctttctctgacaattccctgcgcatgcgtttctccttgctcacggagtaataaccttctcttgtcttgccaaacagcccgctcaggctaccgatcgattccttgggatgcctgagccgaaggttgtctaccgcttggcgccagctttttttagcaggtcgatgccatattgttcccgaccgatcttaagaagctcatgcagagcctcattgcgcaactctgagcaggccaacgccttgcgtaggcgcaagttctcctcccggagcctctcgctctccgtttggggaccggtcgccttggatgattcggatttctttcgtgccatatatacctgatgctctaactctgtcagatcggacggtaaagatagcgtttttgactcaaaataaccttcccagcgactgaaggtcacgtaatcaaccgaatatttcttacatagcctgtacttggttgagccactctcataatactccttcagcatacggagcttgaactccatgctgtaatttttacgttctcttaacttgtttgacatgttacacacgttcttttaattgttaattacgtgtgaagtaaatctgtatcatgtcaaagtctaacggtcttccataaaaaaaattgatgcggttaccctgggctaaaaatgagaaagttgaaaaaaattgctttttagttaagggtgtgttctttctggattgtcttagttatagaaacagataagaatgaaaactgaaaatagacatattaattttcaagagccggaaggtatgatgcttttacggtatataaaggacacagcttccaatgaggaaaaatcttatattgaagcttggctggaagcggatgaaaataataagaggatcttattacagaccgcccgtatatattatacgaacaatgcgatggaacggatcgctagccgaaatccattgattgcctatgaaaagttggaacaacgattagcaaaacggacccgtttatattggctgaagaggttctctgtcgctgcggcttgtataattgctatcattgggctatcaaccttattttcccatagaaaggctgattctgaatttggagatcctcaaattataacacttcaggcaaatgcgggagtccgtacacgctttaatttaccggatggtactgttgtttatctaaattcgggtagtgttttatcctatccgatgtcttatgaccaaaaagaaagaaaagtatatttatcaggagaagcctattttaaagtcactcacaacgaaaaacaaccttttattgtcagtacttcaggagatcagcatagggttagagttttaggcacggaatttaatatacaagcttatggggatgagaatataatttcgactactttagtgacgggctccgtaaatctcgaggtgaagaataaatcagggaatgtgagtcataggacgttactaccatccgaaaaagcgatttgcaacttggataaagaagaaatttctgtgatgaaaataaacacgatgtatgaaaccgcatggatggatggcaaactgatgttcaaggatacgcctttacctgaggctttgaaaaaattgtcatattactataatgttgaatttgtgattcaggatgcggagattaaaagctattgtttaaccggtattttagataataggttgctatctcagacactagactatttgagaatatcttcaaatattgattatcgtatagaagatatgaagacagatgacagcaaaggtactaaccgtactcgagttatactttggaaaggaaaataaagaaaaatgtataataattaaataatatgggcctatggaataaaagaacaagaatgtagacttggtctatctaaaaaacatatgggaaaatgttaccagcatcttcccatatgaaacaatttgatagaaggtctttaaaccgactaagaaatttattttttaatcttaaatcaattacaaaaatatgatgaataatttatatttccaacttgatggagataaatcaacgtttgtcaggttggtatctaaaatatcaagaattatgaagttgaccttatttcttgtatgtttatcaattagtatgtcatttgctatgacaacaaatgctcaaagcacctcactttcttttaaagcgacagatcaatctataaaaaaagttttggaactgattgaaagtcaaactgatttccacttcttttataatagtaagctggttgatgtcagtcgagtgatatcagttgatatagaggatgaagatctcatttctgtgttggagaatgtgtttaaggattcgagtatcgggtataaggtagtaggtaaggatgtgatcttatccttgaaaaatcttagtcaaggacaagatggaaagaccgtgactggtacggttgtcgatgaaaacggtttacctgttattggtgcgaatatcgtggaaaaaggaactgcgaatgggacgattacggatatagatggaaggttctctattagtgttgggaaaaatgcagtattggttgtttcctttatcggttttaatgtgcaagatgtcccagttgagggtaaatcaaatctgactattgctttaaaagaagatactcaggctttggaagaggtcgtagtagtggggtatggggttagtaagaaatctcatttaacaggttctgttggttctgttaagatggatgaagatgttgttggtcgtcctgctgttgaagtggggcagtctttgtatggaaaagttgcaggtgtgcaggtgataggaggctctggtgaaccaggtagttcatcttcaatacagattagaggtgttaattctatttctgcaagtagtgctcctctcgtagttatagatggagttgctgttcctgattatgatatgaatttgatcaataatgctgatgttgagtctatcgaaattttaaaagatgcttcttctgcggctatttatggatctcgtggtgcgaatggtgttgttttgattacaaccaagagtggaaaaacagaaaaaccacgagtaaatattaattacttgtttggtgttcaaaaattgttaaagaaaattgatgtcatgaatagtcgggagtacgcagaggcttatatggatgccgcacaaaatggttgggttgatagtggtggtgatcctaacgcacctaatacaatagaggcgcgtggtgcatataaatatacatggcctgaagcatttgagcatcctgaaagtttatatgatattgattggcaagatgtcgtatttgatgcggcaccaatgcataaattggatgctaatatttcgggtaaatcggaaaagtcagattacttgatatcggctggatatgtcaatcaagcaggaattttattagactctgattataaaaagtactcattaagtcttaaattgaatactcatataaataaatatttggatgtgggtggcaatatgagtcttaattatggagatcaaaaagaggtctattggagaacagcagagtgggcagtccaatatccttctgttttccctgtatatgcggagaatggtcttcttggttgtaattcatatctccctggtttcgaaaaatataatacaatcctttttagaccgaatatgggccatcctctttatatgaaaaataatgatgcaaatcggcaaattctaaatacgataggaagtgcttatgtgtcattaaatttattacctggactgaagtttaaatcttcttttaattattatttaaaaaggaatgattataataattatgaggcaaaagatcatgacttaggagaggcttattatactccaggacaaatgacagttgatcaagctagaaagtggaattatacatttcaggatctattgacgtatgataaatcttggggtaatcatgaattttcattcttgttaggatttgaatttaataaaaatgactattataagactagtcagtcaagaagggactatgataatgatttattgcatgcgttaagtgcgggaaagaccgttttgtcttcaagtgatgtaatcacaaagaatacattgatgtcttattttgcaagagtaaactataactataaaggccgatatatgctttctgcagctttccgtcgtgacggctcctctcgttttgctccgaataataaatggggaaattttccctctatttctttaggatggttagtgacggaagaggattttatgaaaaaaatggattggattaatatgttaaaattgcgagttagttatggattgacaggaaatgaccattttcaagattatgtttgggtggcgaaattaaatcaatctaaaattgcttttggaaataatttaacaacttcatattatccatccaatataactaatcctgatttgaaatgggaacgtacacaacagttaaatgtgggattagactggggagtgttgaagagtcgtatacaagtaggattagattattattattcgacatctgatggactgttgttgaatgttccagttcctgctataacaggttattcttctatatttacaaatatcggtaaattggagaataaaggtattgaatttaatataactactcaaaatattgacaataaagatttttcatggagtacgaatttcaatatatcaaaaaataaaaataagattcttgaattagggccaagtggtgcttctatgatctttactccaagtagttttggtggaatgcaaaaaattaatgaggttggtcactctgtgttcaatttttatggataccaatatgatggtgtttatatgagccaaaaagagatcgatgctgatccagcgcattataaaactgcaagacctggagatggtcgatacgtagatgtaaataagaatggtgtattagatgcaggtgatagaactcttattggagatcctaatccgaaatttatttggggatttacaaataactttaagtataaagattttgatttgagttttttgttccagggtgctcatgattttgcgatatatgatgataatgctcatcgttcgttgatgtatcatgaaggtcgaaattttttgaaagaagttacaaatagatggcgttcggaggaaaatcctggtgatggtgagcattacagattgtctgtagacttaggagaatatgaaaagagaggatcaagtttgtggattgaccggacatcttatattaggttgaagagtttaacttttggttatacacttccaaaaaatatttcgaaaatagcaagtttgcaatttgtgagattttattttaatgccttgaacttatttacgataactggtactgatgtttgggatcctgagtcgtttagaggggatgcctcagatgcttctgcaagaggtgtgatgggaaatatatatccatcttctaaagttttttcttttggtgttaatgttggattttaattcataatgtgatgaaaaagtatattttgttaatcgtaatggctgtcatggtctcttgtagtgaccagttagagctttatcccgagacaaatttaacagaaggtaattattataataccgaagaagaattgtcgttggcggctaatgatgcttataggcaattatgtcggatctataatgcgaatgggctacctgatttgtttggagaacgattctctgataatgtatgtgtgatttttacagatggaggaaatacgtatacggaagatatagtgcttcataaaattaaatcagataatggaacaatactatcagcgtggcgaactgcttataatggcatctcaataattaacgatgtattatatcggttggaaaatacatctgtctcttttacgtctgatgagtttttgaatagaattaaagcagaacttatttttgttaggtcattgatatattttaatttgattcaagcgtttggtgatgtacctttcttattaaaacctgttactgtttctgagagttattcttatttgcgtgaagataaaaatcaaatatattctcagattatagcagatttactgttttgtaaggaatatttacctaagtcatatgaaggtaaggatgttggcagaataacaacttatgcagcatcttctattttggctaaaatttatttgattcgtggggataaagattctgctaaaatagaattaaaacgaattattgattctggaagatatagtttggatgctaataatgatggaaaagttgatgttgaagattatgcgtatttgtttgccccatctacaaaaaattgtaaagagtctattctggaggctcaatttttgtcgggcgtagacaatgtaaatgcggaacatcaaaatcaatatactccttttctttggtcttttcatttacctggttcttctgacacttttagaggaggaggtaaaaatactccaagtaaagatcttttggcagaatatgaagaaaatgatcctcgtatgaatctctctattgtcccaggttatcaagatgaaggtgctaatatttgggttgatcatccttatacttgcaagttctatgatcctgattggcaaaaccctggacaaaactttgagattattcgttatgctgatattttattattgtattcggagttgacaggagatgcaacttatttgaatcaagttcgtgctagagcaggacttcctttatatggaagtgattcgtatccaaaaaagtataataatttggcgttggctgtagagcatgagagacgagttgaattggcttttgagttccatcgtttttttgatttggtaaggactaaccgggcgttagaggtatttaatgcaaagggaatcagtttatctgaaaatagtctgttatttcctatacctttggttgaaaaggatattaatccagaattaactcagaatccaggttattaataatataagaatattatgagaaatacatgttttaattcacttttgatatttagtggagttttgggctctggaaacttgttatttgctcaagagaaacccaatatcgtggtgttcatagcggatgatgcaggcatggactttggttgttatggtaatttggcaattaaaactccgaatatagacagaattgcaaagcagggagtccgttttcaaaatgcgtttttgacatcaccgcagtccagtccatctagaaccagtatgatgacaggtatgtttgcccatacgattgggacagaggatttgcatatgccgatcgatgaatcgactcgtatgatgccctcctattttaaggaggcaggatattttacgggctctatgttgaaaactcattggggttccaatggggataagcagtttgatcggatgatctcgggaacgtatcttcccaatggtggggatttgtccgaagagacctttcggaattacgagcgatttattgatgatagtgctgatcatccgttttttctttgggtaggattccatgattgccaccgtccttatttccgtgatgtctgccctcaggagaatgatccttcaagagtgaaggttcctccttatttggtggatggagcggatacacggcgggatctggcggattattatgatgagattactcgtatggacgggcatataggtcggatgatctccgtcttggagaagaaaaagctgatggagaataccattattgtctttttgagtgataacggaatgccattcccccgttgtaagggttctttatatgattcaggcatacagactcctctggtgtttatgtggaggggtatgatccctgagaataaggtgcattctaatgggttggtcagcacggtggatttggcggctacgttgttggattttgctggagtacggatggatgagtgcgtttatagtaagagctttcgcaagctgttgtttgatccgtcattgaggggacgtgattatatcttctcggagcggaattggcatgacacggacgagtatattcgttgtatccgcacggagaatatcaaactgatctataatgcgtattacgatattccgcatggtacggcaatggatttaagctctagtttaagctggtttgagttgaaacaaaatcagcgaaatgggactttgaaacctgaacagtctcagatattcgtagctccaagggctatggtcgagatctatgatttaaagaaagatcccaatgagttggagaatgtggccgatcgtctcccttatgcggtagactgtaagaagttggcgaaactacttgtggaatggcagaaagagacaaaggatcatccttggtggaagcggcgtagaccagatcagaatgacagggtgacaggattccctatatttcctagatctgagacgttttgggctgattaatacctttgaatgggttgtgtgaaagagagctttgtctgttttaatagaaaggggtatgccgaaaagcatactcctttttatgagggattattatggtaagcatccgataaggtatacattgtaaattcataaaacgacaagctcttcttgtcagcgaatataaagttgataggaagagtttgccattctagtgtatctttgaaacaaaattcatgttggtgaattttaataaaaaatcattatgagaaaatgtagtgtattttatggtactttgttagcgttagtattggtgagccttggtgtaaaggctgataacaatggaaatgaaaacgtgggacattcgggaaagacatccgaatatacagttgcggcttatatttggccttcctgtcatgatgacccgatgggacgggaagtattatggccagagaagacgggtgagtgggagatcatcaagaagggtaatccccggtttccgggtcattaccagcctaagattcccttatggggttatgagttggataacgatcccaaggtgatggggcgttggatcgaggctgccacggaccatggggtaaacacgtttatttttgattggtattggttcaacaacggaccgtttttggagggatgtttgaatgatggtttcctgaaagccaagaacaaccagaagatgaatttctatattatgtgggccgatcacgatgtggctcgtaattactggaatgtacatcgttataaggaggataactctcgtctgtggaatggggcgatcgattggcccaatttcaagatcatcgtgaagcgcattattgatcaatatttcaaacgccccaattattataagataaatggggaacctgtcttctctgtttttagcacggacaatttgatcaaaacattcggttcattggaggaaactcgcaaaggtttggactatttcagggaggaagttaagaaagctggtttccccggattgcatgttcaattaatgacgggtggtgtaccgaatgctgatttcttgaagcaaatagagatgttaggtattaatagcttaactttgtataattggggaggcccacatccggaggattacattcaatggggaaaagaggctttcgagcgtttggagaaatggagcgaagccgtttctatcccttatttccccaacgcatctataggttgggacgatacgccacgtttcccgcataaaacacagaaggacgtggtgcattttaatcaatccccagaggctttcgccgctttcttgcaaaaggcgaaagagtattgtgacaggcatcctgaacagcctaaactaatcacggtttacgcttggaatgaatgggtggaaggagcttacctcttaccggatgtgaagtatggtttcggctatttgaatgcggtgaaggatgtgtttgttaatgggaaatatcaagcttattaatgcgagttcggaataagctatagcctgaaaaaatgaatcggcagtttgaaaaagttgccgatttgttctgtttgtctgacacaggacttcattcggttagtttggaatttcgttgattaccttctgattccgatccacgtactagatctcctttaccgatgaagtattacttaatttactgatgaagtatatatcttatggggaagtaggtagtaaaagtcaaacggtctcctgtaaaaaatgatgcggttaccctgcttttcaagaggaaataacctcttcttatttttttattttatatttgttcggtcaatatgtgctagaagagatggatgtagaacggatatacctagaacgattacgaagcggttcatacagagactttacgaaactgtatgaatcatacgcttcacgcctatatgcgttcgcattgcacttgactcattctgatgctcttgcaaaagatattgtacaagagacttttatcaaagtgtgggtgcggagagaacaaattgatttagatatgtctttcagtgctttcctatttacgatggccaagaaccaattattgaatgagtttcgtaggcaggcaaatagtccacttttttgggaagatgttgtactaaatgagtctggagatggagaggaaacagcgattgaacgtaaattatcttttgaggaatttaaccatagactggaaatagcgaaacaaaagttgacacctcgccaacgagaactgtttgagttaaataaggaacaaggtataactataacagaaatagcggctaaagcctttatttcagaacaatctgtgcgtaaccagttatcgcaagccttacatgttttaagaaaggagctcggtaagtatgctttgctgttctctcttttctttatcggataaataaaattgaaaaacaatattcttatgttttataacatctaaaaaggcatgttataaattaacggctcatgtgtataccttataaaaaggatattatgcaggagtcacatacatattatttgctctcaaagtacatggatcagacgatctctacggaagagttgaaaacactacggcttttggttaatttgtctgatgatgatgaattatcgttgtcattgtctcatttatgggaaaatgggcgaccctttgaagaggttgatgagagaatcatacgagatatgttcagtgagattcaaaatcgaacgagaaaagaacgattcgttatggtgtttaggaaactggctcgtatcgccgcaatactattaatacctttattaagtatattgtctggttatttatatttcaatccagtcgatcagaagggtagcattggcaatttagtggttcatgccgatagaggggaaagatcgggggtgactttaccggatggaacacaagtaaaactaaatgcggaatcgagcttaagttacactcacgatttcggtcgagagcttcgacaagttaatttagagggagaggcctattttgaggtgactcggaatgaggataaacctttcgtggtacatactgaatatctggatatagaagtgttgggcacaagttttaatgtgtattcgtatgagcgggagaatgtcatggaaatggccttgatatcgggacggatcaagatacagacttgttcagacccttctcgtgtcgtttatctaaaaccaaatgaaaaagcattgttcaataaagaatcgggtattataaccgtggagaaaacagataatcgatttgaaacggcgtggttaagaggagacctcgtttttcgatcaacgaaattaagtgatgtcttggccaaactagagcgtagatatggcgtgaatatccatttgaatgatttttctttagcgaatgacttatttaccggaaattttgatagtgaatatatcgtagatgtaatggaccttttagagaggcattatgactttacatatgatatacgaggagatgatatctttatacatccttgagcgagtgaaaataaaatgtataaccttaaatcagttcttatgcgacaagattcttcataataaaaacggaaccgaaaaatggtcgagattttccggttccccaattaatactccatttacgagaatggcgatcaagccataaaacggattgtatcaattttaaaaaataatatatgttcaaaagtagaaaaaatcaatgtagctatataatttttttggctctatttctgttttttaatcctattttggtattagctcagacaggaagtgtcactctttccatgaagaatgctacattaaagcaattttttgaggctgtagagaagcaaaccacatatatattctcttatcgggatgctatagtggaaggaaagaaagaggtaactttaaacgtgacgaatcagccgattcggcgtttgttagatgatgtactgcatcaaagagacttgcaatatacgatgacagggcattcaattgtcgtaactttaaagactgccggtaatgtaaagctggtatctggtactgtcgtggatagtaacggtgaaccgattatcggagcgaatgttgttgagaaagggactacgaatggaacggtaacggatatttcgggaaatttctcattaaatataaatgatagcggtattttacaggtctcgtatattgggtttaatactcaagatgtagctgtgaacggaaaatcaagtttaatgataaacttgaaggaagatactcaaaaactggatgaggtagtcgttgttggttatggcgtgcagaaaaagtcgaatgtaacgggatctgtggcttctattaagacggatgattttaatgatttaaatatggatgtgtcgcatgttattcaaggccgtgtggcaggtgtcaatgtttccaatgggaatattatcattcgtggagcggcttctatcaatggcgcagatccgttgtggatcgtggatggagtgccgggtagcgctcctaattttaatgatatagaatctatcgagatcttgaaggatgcggcttcgactgctatttacggtgcccggggagcaggaggtgtgatccttgttaccactaaaaagggaaagatagggaaactttctattaatgcgagagtaaactttggaatagagactccgatcgatttgccggatatgctgcataccgcggactttattgaccggaaattggcggcaggcttccctaataatcccaattccggctgggataatcccgcttcgctaccagatacagactgggaagatctggtttggcgtaatgcttttaggcaaaactattttttatagatgacgggtggtaatgagaaaactacatttaatatgtctgcggagttctacaagaatcagtttatcgaacgttattcatttgaggatgcgggtaatttccgtgtggctagccagacaaatataagtaaacgcgtgaaattttccgagatcatgactgttggttttaataatacggatccccatttgtatgggcagacgaataatgattatgtttattaccgccaagttcctacgatggtgccttatgataataccaacgaagctggtggaggttggggaaaacatccggcaggtggttactacgagggacctaatcatgtggctacactaatgtctcatcatgagaatgaacgtaggttttgggcccgggcaaatgcgattttggattgggagattatcaatgatttaaaattccaagcgaatttctctgccaattttgactcccatgcgaataatttgttcttagagtcatggaatttgggatctttatctcaacaggattattactcgaaagattatggctccggttatgatttacgtatgttatatacattgacctatgaccatacttttggggagaaacactatgtaaaaggtttggttggctacgaggcttatcgggcgacggcttcttcggcaggtggttggaaaaacggctttttggttcagccttcggatgatattagtttaggtacgggagataaagatgtatccggaacgaaaacggaaggtcgtagtttatcccagttcgctcgtgtaaactatgcttatgatgacaggtatttgctagaggctagtattcgtcgggatggttatgataactttggtccagagaatcggtttggtgtgtttccttctgcttctgtcggttggaatgtgggaaaagagagcttcgtaaaggataatataacatggatgtctcaattgaaattgagaggaagttatggtaaaattggtaacaatacaattcctcaattcttgtatgaaccttcttttacgaataattatctatattattcatatgataggcaaaatacgcagagaggattctggtattcaaatgttgcgaatgctacgattaaatgggaagacgtggcccaatggaatataggtgttgacgcaagttttctggataatcgcttgaatacgacaatcgagtattatgataagaaaacttccgatatgttatattcagtaggtgtgccaccttctgccggaccttcttcggaaccatttagcgagacttcttcttatcgggctaatatcggaaagataagcaatagaggtttcgaatggatggttcaatggagggattcctataaagatttcaggtatgacgtggcttttacgttgtctaccaacaagaacaaagtggtaaagttaagtgaccaagtgaatccgatcatttgggctggaagcgatgcgactttgaatagttctatttatcgtacggaaaatggacaaccgatgggacagatgtatggatatgtcgtggatggtattattcaagaccaagcggaaatcgatgccttaaacgctcaatctccggatggattgtaccaacaagcaggtacggctccgggtgatttgaaatataaggatttaaatggagacggaaaggtgacgaatgaggataagacatatatcggtaatccttggccggatttgatgtatggattgaatataaatttgtcatggaaaggccttgatttaagtatgggctggttaggaaacgcaggtgttgatgtctttaatagcgctaagctttatgaaagaagtttctatggcgactataatacgacttataaggtatatgaggcgtggagtccgacgaaccgggctacttcacatcctcgagtaacgaaagaggacccgaatggaaacttcaagaatgtctcctcttattttgtggaggatggttctttctttaaattgaagaatttacatttcggctataatttaccgaaatcaatactttctcatttgaagatagaaggtttgaagttttatattaattgtgataatttatttattatcacaaagtttcaaggagatcctgaattgggtggtggatatttggaacgaaatatgtattctgtgaaacgggctccatccacccgcaccattatgggcggtttaagtttaaccctctaaattaataggaagatgaagaaattagttatattattagctgctgcgttaacttttaatagttgttcggatagttttctggatttatcaaatcccagtgcgttatctccaagtgtctaccctaaatctatggcggatatggagactatcgtaacatcagtttatgcgaatatggtcgctgtgcctttgtatggaaagagggttatggcgaaagggacattctgtgtggatcatacggtagatatggcttggactggtgacgccaactggaaccagttggcgaccaatcaagtgacttctgataatgcttacattgggacgttatggattggttattataaaatgatttcttgtgcgaataccgtattggagcaattggaaagaatcgacaaggagaagtttacagatgcggatttagtaaggctttcgcagatgaagggagaagctttgttttggagaggttgggcacaccaacagctagtagcgttttttggagagggatatccttgcaacggggagggcgatagaaaaggtgtacctgttcgtttacaggtagcatcgactccggatatgctaaatatagaacgtagcacggtggccgaggtttacgatcagatcttgaaagattatgaggcagccaaacttttgctacctgctgtatgggaagagagggcggactatccacgtccaacctctgttgccgttactagttacatcgggcaagcgaatttgtatatgggtaattatgatgcggcaaagaaagcgttgaaagaggttattgattcttccggaaaagaattgctccctttcaatgaatatgcgaagatgtttaatgaggatcaggagaaatttaatagagaatcgatcttagagattaatttccgtaatggggatacttccggatatttttggtatggagaaggttctcaatatggattgatcgctgccttatgtttccagaacgcaagtggagatgttgaggcggccggttggggtaatattttctttcatgatgcgaatattaaacgttttaatggagatcctcgtttggatatcgccgctttgcgtccgggaactcctgttattatgaatggacagcagacgcaggttctgaaatataaggatacggaggctgacattcaaggttggagcatgcgaaaatacaatccgttgaaaagtacggtgaatgagttgaatttaggggttggtattaatatgtatttgatgcgtttggcggatgtatatttgatgtatgcggaagcttgtcaggctacgggagatgaggtaaatgcccggaactatatgaatctggtaagaagaagagcttataatggagatagttcccatgatataacggctagtggagaagctttgagagatgcgattcgggaggaacgtttcatggagttctgcggtgagggcgtacaacattggcaagatgtttgccgctggaaggtcttggatgaggagattagccgttggtatggaaagacacgtgttggtaatccgcattatgatgcgaaagatttgtatttcccgatacccaaggttgaaatggagaataatccgaatatgacacaaagcataggttacgagaacgagtagatataacttgttgaaaagttcatcaaagaaaaggaataggatggttctcttgggatcgctaatcctattctttttttattcctttatgatcatattaaatcttattgaataatgaagatgatagatgtgtcgaaagtaagagtctttcgggggagtctctttgtattgtttatgctctttatgcggataggttgggcctcaaatgatgatagcacctataatatcgtggattttggagctaaaggagatggaataacagacaatacccagttcatcaacaggacaatagaagcttgtaccttgagagggggaggaacggttatcattccggagggaacgtttttgacaggaagtattctgctgagaagtaaagtaaacttatttttagaaagtaatgccgtagtgaaaggcataaataatctggaaaagtaccgttctatatccgatcttaatcaagatgagacttattataaagtaaaaccccggaattggaacaaggcattgcttttaggagatcaagttgaagatgtgtcaattacaggagagggggtaatcgatggtgcccatattcaagataaaaaaggtgaagaagggatgagaggccctcatattctctttttgtcgagatcgaaagggattaagatatcgggagttaaactacgaagagcatcgaactatgcttttatgagttatgatattgaaagggcttctttcgataatcttttagtggaggaaggatgggatgggattcatattcgtggcggaaaagatatccgtatccgaaattgccgttttaatacgggtgatgatgctgttgcgggtgggctatggaagaatgtggtaatagagaattgttatatgaactcatcgtgcaatgggataaggttgataatgccggctactggtttaaagatcgttgattgtgaatttagaggtccgggaaaatatccacatcggacttccggtgagcaaaaacgtaggaatatgctttctggtatattgctccaaccgggcgcatggttccctgcgtttggggaaataaaggatatattgatatctagctgttcttttgatcaattggataatccgtttctagtcacattgaatgaggggaaccggggagagcggatctgtctggagcatataagaggtacacgtttaatgaaagcggccgcctcggtagagagttggggagatagtagtttgaaagatgtccggctttcggatgtttccttatcgtatgttggaaacaaaggtcaagaaatagtaggacgtactccctcgaagccattgaccgattatcgtgcgctcccttgctgggggctttaccttcataatttagatcgagtgattttacggaatgttcgattagtttgtgagagtgggaaagttagcccagcctcatgcttcgataatgtggggtccgtggagatttataatgtaagtttttaatcttaaaaagaattagtatgcgaaaataccttttgttttgtctagctttttgtgtattgggttgtttggctcaagatttgatcgtccgtccgaacgatcctattatttataagaaagagggcggtgcctttttatggctgggggatacggcttgggagttatttcatgtattggataaggaggagatcgttcactatctggataaccggcaagaaaagggctttacggtaatacaggctgttatcttatctgaactggatggtttggataaaccgaatgtgtacggatatttgcccttggttgataagaaccctacccaaatcacggaaggatactttgagttagtggatttcgtgattcgagaggctggaaaacgaggactgtatattgggcttttacctacttgggcgagtaatgtggtagagaaagacggaaatccggctttgtttaacccagataatgcgtatacgtacgggaaaatactgggaacccggtataaaaacgaagctgtaatatggattcttggtggcgatagaaatgtagttacggataaggagttcgagatctggcaatctatagcgaaaggaattcaggagggaaatggaggaacacaactaatgtcctatcatccgacgggagagatttcctcgcattattggttccacaatgagtcttggctatcattcaatattctccaaagcgggcattaccgccggatggatccggtatatcgtttttcgggtatgtatgctcaattgaacccgattaaaccgtttgtaaacgcggaaccttcatacgaggacataccggttcgtttctgggaatattttgattatgctaagttcgggaagaaaaaggaggacataataggtgataacggattgattaaggatacgacttattttacggatggaatttacgatgactatgatattcgtatgcaggcttattggacttatttctctggagctgccggatatacatatgggaataacgctatttggcaaatgtataagccgggtggtaaatatcatgtaccatgccttacgttttgggatggtgcgttggataggccgggagccgaatgtatgcgctatgtaaagtctttgtttacgatgtatccgttagatcgtttccgtccggatctatccgtcctgttcggaattaattacaatgacgcaagctatatcactcccgttttagcaaaagataagacttttattttagtttatttgagtcaagggcaggatgtaagaatacaaatgagtaaattgcgatctttaggtaaagcttattggttcaatccgaggaatggggcgagaaccttgatcggaccggtcgagaataagggaattcgtacattcaatgcgcccggagaagcgggagagaggggaaatgattggatcttaattttggaggcggatgataggtagacgatgtataaattttaaataataaaagtcattatgaagaagatcaatgttttgctgttagcctttttgctgttaagtttttgggcgaatgcccagcagtatccttttaacgggttggatatgaatatgggaaacctttctcgtttgtcgaatgcgcagagtcgttcgatcagtccggagaattttacgggggagaaagggaaaggagcgatggctgatcccgtgagagataaggatgtccggaataaggcgaatgcggccggcccagcgaaagatttggggaaaggctggaaagtaaatccttttattatcgtgaaaccgggggagacagttaccatcgcggagattgatggcccgggggctatccagcagatatggatgactcccactggcaactggcgattctcgatactccgtatgtattgggacgacgagaaagagccttcggttgaatgtccggtcggggatttcttcgccagtgcttttaatgagtatgcccaactttcctcgttggcggtctgtgtaaatcccgggagcgctttcaattgctactggaagatgccgttccgtaagaaagcacgtataacgttggagaatattaataatgcggaagagatgcgtttgtattaccagattaattataccttgacggaagtgccggaggatgagggatatttccatgcgcagttccgccgttccaacccgacacaaggctctatccatacgttggtggatggaatcaagggaaagggacaatatgtcggaacttatttagcttggcgtgtcaatgataactgttggtggggtgaaggagagatcaagttctatatggatggcgacaaggaatacccgacaatctgtggaacaggtacggaggattatttctgcggttcgtataacttcgagaatcagaaaacacatcaataccaagaattcaccactccttatgcgggaatgcaccaagtgatccgtccggatggcctatatcgggctgttacggcgttcggcttgtatcgctggcatatcttggacccggttcgttttgaaaaggatctgaaggttacgattcaagatttgggttggcggcacgacggtaggtataataatcaaaagtcggatatctcatcgactactttctggtatcaggtggaaccacacgctaaattcccggcattgcccagtaaggatgatttggagattccgagatggtaaatggcctgtggtaagatgttaaatgttatttccgattaaacctttcctttttatcgatgtctattctttcgaagcgcttcataaacaggtaatttataataaaagtaataagtagtagtttatgaaaaaggtaataggattgtgtttggttgtattgttgagttcaacttctgtgttcgctcgtgagaacaggcgtatggacaagcgtaagatggatccgtccgcacgttgcgagaagatgatcgccgacttgaagctggatgagaaacaagcggtggagttccgtaaacttcaaaaagagtatatggaaaaggctcaaaaagaacgtgaggcgatgaaggctgagcgtgagaagcaacgggaaaagatgttggccatgcgtgaggataagaacgcccagatgaaaaaaatattgacggaggaacaatacaaacaatatctggaaaaacagcagcctaaagggaataaacatggcagaaaacatctaggtaacggacgtagataaagaagtctatagatagataaaatggccggggtagcgattatcccggccattttagttctaatcggctgcttcaaccacataccaagtatatccgttggcagggattttaaccgtaagctccaccgtatagtcccggttcagtttgtaggtgacaggcttttgctctttttcccggatgcgggctgtttgtgtcaggccggtataatagagtggaatatggatcgtacgggtgatctcttgatgggtcggattgaagaacatggctagacctttctccttcttgtgaggattgacgtgtatgaacccgtcccagtctcgtgcgtccggccggcgtaagtggatcatatcgctgttgagtatatcgcggtatttcttataccattgaataacctcggttacggccgcttgggtttccggggtatcatataggcgtggccctcgatagcaagcttggacaccagctccgtaattttgcatcatatgtgttttgtattcgaacaagtgttcgtggaggggctccaaggtggcggcctctcctcctccttgatactccacgagaggaacgaagctccagcatgccgaagccatccgatcccatgtaccatcataattcaattggcgggcatggatgatctgccggtcccggggaagcgaccagttggcttcacggtaaccaatgcctgtcttggtagacccgttcaagaaatagaaatcgggaacattgatataaatgccattctcgcacatccaacgatagagatcggttatcttatggaactgattccattgggaatcttccagccctttatgataggtatggtgggtggaggcgcatacgtcgccgggataggagccgtcgtgctcgaagcaacgcatgcccgtacgctcgaagaaggttcgtatatgatggaaatactcatatccccaatcgctgcaaaggcagggagcgctaccgaaacgcatcccccctcgttttcctgtcttgggattgataacatctacctcgtcgctgatccaacggcttgataagagggagtaacaccctaactctacacctttgttgcgggcgtaatccaccaaagatttatatttgacgatattttcttctgagatatcctcggcgttcaatccggatccaaagctgatgataaccatctcgtatccaacggtagcgcattgattgatagcggtacgaataacatccggatcggaagaggtaaggtgcatgaagatcggattctccgtagcccatggagctaccgtataatgtaagcgtcgtttaaacaaacccttccgttcccgatcatcgctgtcgaacggcatctcgtatacgctaaaggatttgaatttctggcccgccgctagggtataatcgggacctagtttgggcgatacgtctaatatacaaggcgtgagcaaaggataattgcgttgggaggtatattccggatcggccacccatttctctgtgatatcggtttcccgctcggtaaactctccgccacaagcatagtcgctttctacatgtatgttcggaagcctgaatttagagggatctccaccgccgggcgactccggttcggcgaatgccagatattccaattggaaggcatcgatatctatggactgcggggtattgttggtaacctccatacttttccggataactgggatgtgatcgtataagtcgtaatggagttctacggtgacaccttctgtttctttctctcctttcaatacgaaagtcagtcttttccctgtgggtacgttcttattcagtgcccagcggcttctggcccatttgatatcttcctgtagctcttctatgcggaaatcctcaatgagaaaagaaccggggcgagtagtcatctggtcgacccattccatttggaagtatccgcgctcgggctggccggccagcccgccaagttcccaacgtttcccgtcaatcgtcaaactaccttcgctacttacggcacgaagcatactttctccggtcatccggtttaagatatcgagagtggaaagattgggtaagacacggaacatacgtgctaccattccgtttgacaataagatgcttttgccatctggagtcgcatatatgccggcttttgatcgtgagggttgtaaaagccagtcgaaagaggtgttttccaaaggaagcccttgttggggtaattgcttgattttatcaagtaatttcttctccgtaccggatgatacttccggccctttcccttgatagctcgtggagacgatcgaggggatgatctccatatactctatttggggcgtgatccataaggcatgatctccgctaggtccatcgtcggtaggctctacgataagatccaatatctttatgccattcagggggatatcgattgttttcggggcatcgccaagtttgacgataccgctgttataaagctccttgtcatctcctttcaagataaataaggccgagcccggatgtacttttccgtctttaccttctagaccaacaaatgtcttggcgttttttcgggtatcgaaatacattttcgttccgtcaacaaaagggataaccgtgaggcttttatccgtataatcgatatgtgaatcggcgatcccgacctgcgcttgaaagcgtgacgcattcttgtgtaaatcgatcttgatatgacttttagcttgtaccccgatcacgtcatcatacgtttttccttgtatagaggcgggctcgttggtaactgatttccctttgacggcgccaccgtaagtttggtaggatttatttaggtccatgtccataagccggatctcgttctggcccatggcgtagagaccggcaaatcccgaaaggatagctgtaaagataagtttattcataaaatccagtgataaaagagggtgttatcaatgataaaaataaggtgcttcaaaaagacttcttttgaaacaccttatttggtttataatctagcttcgttctattataatgtcgtaagttttaaatttcgccaaagaaccttgatgcctccaccgtcgtgaatctgaagggcgatgcggcctttacccgctccgatcttctcatcattcaagtttaccatttcctgtccgttcagccaagtctgtacgttgtcgccttgtactttgatacgcatcgtgttccaatcgccttctttcaagatattctctttctcatccggaatctgaaccaaccagccacgtccgtacgactcatagataccacctgtatcgtggcccttcggagctacttctacctgccagccgtttactttcacgccttcctctacgaaagagcggatgaatacgccggagtttccgtcagcctcttgcttaaactctacggtcagatcaaaatcatcataataatcacgggtagcgagataaccgtattgcttgtcgggaccactttcgcaaaccaataaaccgtcttttacgtaccatttctccgtaccgtatggttcccatcccgtcaaatccacgccgttgaacaagttcacttccttaccggccttacggggaagttccttgatcttcaagttacggaaagatgcgggataaccatgatcttgcaagcaaagcacaccttttttcgccaatccgtattccggcgcgttggcccatttgccgctatttttcttagcgtgccaatcgtctgtccatgcctcgaactctaggatcttttgtccgttcaaccaatgttccacatgtccgttatcgaatacgatcttggagttgttccattcgccttgcggattcaccttcatcttggatttatccggcaaatgcatcgcataatccacacctaatttctgccactcttccaatgggtccgggaagttcggctcgtcgatcaattgatactccggccccgttacgtaaggaacagcgaattggggacgctctaccacatggtacaacataccgctattgccacccttggacaatttccagtcccaagaaagctcgaagttctcatactctttatcggttacgatgtagccactagcgtcgctgccatctcctttggcttgtatacaaccatccactacatgccaaggctgtgtcaatgtagtcccgttgtaatctttccaaccatccaatgtctttccatcaaaaagcagaacccatccgtcagcgatttcctcgggagtaagtgtgttttgttcttgactggcacaagaggaaaacaaggccagcgataccgcacaagaggctaacaagcttgtggcggctgtttttttcattacagattccatgtaaataaagaatttaggttgataaattgtaactgaatggcaaatttacgtaaatatctttgatatctctctctgttggaggaaaaacgtttctctccctaggaaatacttctccaagagcctatatattctttgtcgaataagctctatttcttaatttggcggcgctgaatttatattcacagccgctgaatatacaaatgccgccgctgattgtaaaatcagtggcgataatttaagaatagaataggtaccgatcaggcttacctataggtacgcataagttttattctgggacaatcaacttttatatgtttttgtggaaaagaatctggataatacttgtttaatcgaagaataatatagatattgcatgcatctaataaagactgaaataccctgcaaaccatatgataacaataggtaccttaaaactagatttagttgcggatcgggaacctttcgttcatgatttatatggtcgttgggatacctttaaccgaacctctttagaagggatcgtggatgagattttaagccgttatgatacggaagatgaggatgagcttcttcaaggaaaatttgtggcccaacggcaaacaaagaaccagacagggattccggatcatgtaatccaaggcatggagtcttccttcgggacggatttctcctcggtacgtgtacacccggattcatcgaaagcgccggaggttggggctttggcatatacgcaaggtacggatatccatttcgccccgggacaattcaaaccggatacgtctgccggacagcagctattgggacatgagttgacacacgtcatccagcaagccaagggacgtgtgcagcctactaccgaggtaggtggaatggccgttaacgatgatttatccttggaacacgaggcggatgtgatgggtgctaaagctgcttctgtcttatgaacgagtggatcgattggttccagcgggtattggatgtctccattcgtttgtatttccggcaggagtgcgatttatcttctgtctatgatatcccactcccgaaggcaggaccgctttggaaggcgttgttgccggaacaggtcgatcctactttcgacgagtggatggtgttgatgttggctttaatgcctcatctttctccgcagatgttggatattttttttgtgcataataagaattttgactgtccttatacggaatttggcggttggaaaggactatcgcacggaggattcttgccaacgggtgagacggccgttttcctattggcgggcgatcgtgtggaacgccgtctggaagtggttcgtctatttcgtgaagagcataggttccatatgtatcacgtcgttggcttggaaggagccgggaatggtgaaccgttcttgagcggacaactgcgtatatcggaggatttcttgtaccgtttatcttttgagggagaatataagccggactataatatgggttttctggccaaacggattagtacggctttgaattgggaagatgtcgtattatcttattatgtgcgtgaggagttggaggagataaataattggattacggggcatcgggtcatcctttcggactggggattgagtcgttttttgaaggccggttaccgcactttgttttatggcccgccgggaacgggtaagacgctttgcgcgaccttgatcggcaagaagaacgggatggatgtatatcgtatcgatctttccatgattgtctccaaatatatcggcgagactgaaaagaaccttgcgaatgtattcgaccaagcggaaaaccggaattggattccttttagtgtatttctgtttgtacgaggcatatccggtttgttttatttgttaataataaaattacttccaactcctaaatatccgagttcgagttgttccagtagttcgtctttttggtcaatatatagcaaatgcctatcagaaggaactaatatgcaccaaggttgggaagggctaacgttgaaattttgccttgcctcttccgggtagcggtttagataatagctcttttgttgatcttttgccgtatatacgacatgcgctacgcttaatatatcaatgtccacgatggcttcacactctcgtatggaggtataaagatctgtcgatgagaacgaaagcccaaataccgggatctcttccttatctcgctaaggcgcgatacaattattaatgcgtgcctctgtctggcggagtatatctcctacgggatatccgggctttatccggaggttacagcaaacggttacttcctcgtagaccggagtaatagcgtcaacggtaatgaacggacttgtcttgtcacctatataatcttcgattcgcatgagtagcctatgttcgcataaaggcaagatctttttatctttctccttttgcatcacgaccaatgttacgatcgggctcctgttttgagctttactgtctattccgggcaagcaaagtactttttcgacttcggggaactgagccaatgttatttgctcgtaatccctaggcaatacagcccggttccgatgggacatctcttgggtgatctggagccgcatatcctctggcgtttccggcaaacgtcctcctttagcgggtatgatctggtaaatatccgtaagtcccggcatacttttctcgaaagaaacgagtcccgtgaagctttcgagttcctcactgatcagggcttccatttcttcggggatttctaaccgggctttcactgggtttagatagacatttcgtatggatgaacaattttgcgtgtggcaagatacttttgccgaaagccagaaatctccatttatgtcaagcatttcctcgctaataggtgagggaagcaggatgtctaccaaacctgtattcaacagattcccggttgtatcggaaagcaaattacccggtttgataaactcccattgcttgccgttgaagaaagaccattgtacgcaaggaagatattctttttcgatttcccgtttcaaggcagccatctcgaagaataaacggatctggtcgttaccgatcgagttaccaataccgaatagaataatcccatcttctgtgggtactcccaccattgggaacggatgacgtagatcgatttcatgtaattccttttgcctcaatggatggatatgatagatacggcatctatctcttggggtatcgccattgaaaaagtattcttcctcggcgctataaccgatatctatactttcaatcatagggttgtaaggaggtttgggcaccggggtctgtttacgggtatggctgtttcttatcatgatatccgcaaagagtatccggtactccgtctgcccgaatccgccgttcggatctgtgagtctaatcctgaagaagccttgctgggctttcgtgtattgatattgctcttcttccgtggagaccgtaatgtttttgaacggtttgtcgtaaacgatctcgctgtactccgagagctttcccttaggggaagtatgcttgtttttcgtattgaagagacaagatgtactttccggtaattttacccatttctggtctgttagtttttcccattcaactttgaaggtggtattatcgataggtgtcttatatgcttgatacaaatcatagaaacctccttccgaataaggtagatccgctcattgcaaagtaatacccatggattggataggcttgatcgctatctcataattaccgaatgcgaaccatgagcctttttgagcttctaacccgaataaagggaaatgtacgcttgcgtctacttctcccagaggattatagattttcaaggatgacatgccggatacatgtacctttatctttaagctagtaataaaaatacggtgtacccaagagtaggggaataaccaagcatccgtgttcatcaatatacggagcgctgggttacgtgtttggcaaccatgagcttcagagcaaggtgttgtagggtcgaatttctcattaaggacgaatttcagataaaaggagttttcgttgatgaatgtcaaggtgtaggcgtatatcgggtcccaacctttctctgtgcttaactccaataggaaagcgtcgtttaatacacgcccggtttcgtgggaagattgttccgtagtagcgattaattctttgaaatatgatatagagtcttcttctaatccgaatgtgatatgtatatcccgatgtccttcccgaagtaataacatgggagattcgattatcagtccggcttgtatagaggattggttctcaaagattagctctgagtccagattgggcttcttagaaggaacgtttccgatcctgttattcaactgtttttgccagatggacgtaacgaagcctaatcggctcgctggatattttttcggatctttttccaatagtaacgaatgtatactcgttattttcatgttattgaccgaataatcttcatccgtacgataacaaaattggatatcttgcacaggaaatggtacctgtgttataatacctgtacctttgggtaactgggcttgccgtgtggtattatttttcacggcgataaaccaagcggaaggaataatcgctttttggggagattccttcaatatttggttgacataaaataacggataagcttcccagcgtttattgaactgatctaccagatattgatagtttttcaagaaagcgattaaaacagctaatgagggatcggtctctccgcttttagcgatttcttggatgtaaatctcccgtttgttttgtaaattgcggaggatacgtaataataggtagagacttctacgaaccgttttaggattggatagggttattagctgaagtctctggttatatttctccatatccagaaataaatcggacatggaatctctaaagatccgatgattcaatctttgataccaatcagagaacttatggtatagagcgtttcttagataggtgatttctctgttactttccggtgagttctcattttgccacaaaatgaaactctgttcgatcccgattgtatctgtttgcttgatctcattgagtatggctaaggattggtaatgatataaagaggatgatttcgaaaaggcacgagccaataaattggagagatttttctcgagtacttgaaaaggctcatgtatccggaaatcattctccaatttttttcttgtcaatccatctttattccattgtttattcatcggttagaatcaaaatagataggataggtcaattcttgttggacattattcatacgtatcgtataataaagttcgataatcagaatgccatcttgaatcgaagccttattaatttctatgcgatcaagcgagactctaggctcgtataagagaacagccttctcaatagcgcttttaatcatggtctccatggtaagatctaattgttcaaactgataacgatatagttccgtaccgtaatccggacgatgtattcgctcccctgtgcgagtggagagaaggatgaccaagctttgccggatgtcttcttcataattagacatacgggtgggattatcattatggctgaattctggggggaatgcccatcctttacctaaaaaactatttttgttctgcataattcattcgatttaattaatcattacaacgcctccttttacaacggtttggccggatgcggatatttcggcggtggcagacccttttactttaactcccatttgtgcggaaacctcgatattcaagccatttatcttggtatcttgcttagacttggattcgatacccattccttctgtcttgacattccctcttgccttaaatatgagatctttgccggattctaccataattccgtttttatccatacagaccttgttcttattagcatcggataacagaatttgctttttgtcatcatccaatatgagcgtgttctctccgggagtccctattgtgataatctttttatcatcgtccaaagtaattttcaactggttttttgtaacaattgtctttaaattattttttggatctaaagaaaccggcgtttttcgtttgcgactgtacaaacttccgacaatcacagggtggcagggggcctcattgatgaattgcaggactacctcatcatcgacttccggtagaaataacatgccgaccccattgcttgcgtacggactgaccggccgagcccatatctccgtcttctcacattgtaacaagggtatatcgactaatataaaattctcgaaatctttattatctccgatctttttaacgatccctatttgtaatcctcgtataccgggcaaaaaaccactagctgcgggagcgactacatcgggctcttcggtaatgactaccggattgaaacccatatagacttgtgtcttccattcgcctccttgtagtgtatgttctactgattgaacaaatgcgtttccactataatgtttgcttaatccttctaatttgataatacagcccggaataatagacgcattcccgtaaattgtgatggagccttgaaaacgtgccagaccgctccataaagcttgcgcatcggcccaagcatgtaaagaagcgtcgccgatgggagcgttagtttgataaagcatcacttcatttgccagaccggatagatcctttgcggcgatatcgccttggacattgagaggaggtttgctggcggtggctttgataatttgttgacggctcacgtcccaagcgcaagcttttgtatctgtgtattgctcggaagcggatatagaaccatcgaaagcgattaaattatctccataggtgatggttaagaccggggaggcggatacattcggtttacataccttgacttgtttaccgtcagtgataacgactaatccgttattttgtgctcgtgtgagtacaaaatcccaatctgtacaataatattgtaccagttgtggaatttctataccggtgctatctactttggcggaaagcccgtattgtcccagaatcttcttgataacggtatcatctttactattttcatatacattatttttacgtccaaaggttgcaggatatgcgaaacccctacattctaaaataaatagagtttgttgttcgctattgatttttaactgatgggttgtaacgcatccctcaaataaggtgttgaccttatctgttggacccgcttgaaacttaagctccgtacccggattgaatattttgttgtctggtatttcaaattggctgttgtcgataatatcagcgctgatggagatcgttgctttatcgatcttattacatgctctgtatatttttgcattgattacggagtattgctccgttacatctttaccatttaggaatagtttgattataaatgaattatccatattcattatattttagggaaccataattgagttccgggttttatatctctaaagctgattaggttatttatggaggcaatcattggagcataaccagaatttttatattcttttgcgcataacccgattagactgtctccttgtttaaaagtaacgaatttaccctcagctttttgatttttcttttttgcttgtgtctctctactactaatcgcctctgttagtgacaaggagcctttagctcgtaaaggattgccattgggcgagaataaggtgtaatcccaatttaggctggttaatctccccttgaaaatgagactcccccaaattactttaaggaagcaagggctgggtggatcgatctccgcgctaggaagaaaaatgatattctccaaatccttgatcctttctgtcacggtttttttccccgtcgggataataccggtaccatcgaagtgtatatcaaatgagagagtggaggggttggtgtgtttatactccggtagttgcttatcctcttttatgctttcgtctttcttatatgaggtagatttgcttaacttatagctatccggattgatttggacggtgatactacccaatttctcgccacctttgtattcaattgatttatatgcctcgatgatcaacttttggttcatgttttaccgctcctttctacaagaaaaaaggttagacaaatctttcttggcctcacgaattatctcctctttgatttgttgtatcaaatcacgggagagagggaggtcgggttcctttttctgttgtgtcacttttgtggacacttggatttcttttatagttatagccattgcttaaattgttcttttttcgtatcttctgtatctcttatcgacatacggatcaaattagtataagccatctccaatgtttcaatcaccaactcattcttttgggaattcaatgcgctaatgtcccattttacagggtaagcattgagcacagaccaattatttaggggaaaatgcccggcatccagcaatgatatagttaaattgacgggaacgatctgggcacttccattattttccaatactttaaccacatatgtctctagcacatgaggcaaaggcattaaagaacgtttcaacacaaggttaccgtgctttcgtcgggtaggtacctgatagctgaaactgttttctcccccttctttaatcgtttctgtctccatttcaagttgtagtcccgagacctcttggaaagaggtctcgatcaatccttcgaaagtcacgttgaaataaaacgctaccggaggagggacaatatgatcaaaccttagcattaagcgttttctatggtcaatccttcatgcgctaaatctaaggtttcgatggcagcctcgtttccatcggattttaagctgacgccggtaaccttagtcggccatgcgttcgataatttccaaaccatcgtagggcttcctgcttcatccagtaagctgattgttacatcttctcgctgtattgtgttcatttttatcttgttaaaccaatcgaataatttgttatccgctttgaaaacccctttctttagactgacattgctcgtcttcttcagtcccggcatcttgatatttgagaaaaccgggctattaccatgtcggtactcaattacttgggcttccatatccagaccagatacctctttaaaagcgatttccccgaggctacctaattctaccttaaaataaaaactgggtaacggccatacattatcttgtgcttctcctgccatattcgtatttctttaataggttttaattcttaaattatcagcttttttgcatttgttgttggaatgtgatctcgataaattccgcaggtctggtaatagccacgaatacggatatcctgaggataccttccagaatatcctctggagtcatcgtgtctcccaatccgatatgaatgctatatgcgtcttcgggggaagttcctgctaatccacctcgtttccatacgccccgtaagaatccatctatcatactacgcatatttacccatgtatttgctacattcggttcgaatacataggcacgggcggcgttcttgatcgattcctctaggaagatcatcgtacgccttacgttaatataacgccagtctaacgagttaccatccatcgtgcgggcaccccagaccttgattccttcaccggggaagctacggattgcgtttacggcttttccgttcatcggtacgttcagatcttcttgctcggcatttgtgatcgagagtgcgggcgtgactacgttattgatggaaatattcgcgggggctttccatactccccgggtgttatctaccatagtataaagaccggccagcgaagctgaaggcggaagtaaattgatcctcaagcgaatctctctcaaaatggagcggtatacggaactgacttggtataataaggtatggaaacgttccgcttcgtcctctttcatggtaagcaaaagcttgaacttgtccataagttcattgacagcctcattcgttacaccggacttctttgagaattcgttcaagatcagttcctctaatttctctaaactatccttttctatattataaaaagtgatatctttctcggtgacgatagatgtatttatccatggataataggaggcacagtacgcaaggaaattgctacctatattttcccggaaacttttgataaccgcaccgttttcatctttgtatccgttgaaaacatctaatatggcaaagcgatttttcatgtcgttaccacagtgcatcaaagcggcagtttgaactttgtaacaatcgccttcctccatatatacggcttccggaacgacgaccaacgtgggctcctgttctttttttaaggctaagagcgcatttgtaaagtctatgcttttaaagtcatgctcataatctcctatggagacgatatagcacggtcctccaccgttagcgtagaacaacaacatattataatataaagcatagaacgtttttggcaaagtaagctggcaacttccatcggggaataatacgtttatgtcattggtggtgtcctcactctcggaatcttccggacgaattccgaatcgcaaggtgggagcgaaaccgaagaacgaatggaactcagccatagaagatatacggaaagggataccggtcaagtccttgttaccgtcccgtgcgaattgggtatgcccgataaaggcagggatggcggtagcgacttctacgactgaattaggaaaagcgtttttctctatgatataaacgccaggggttttcatttgtgccatacgttattttttaaaggatttagatataaagaatttgtataatagaattctcggtagattgtaattcctttataaggaaacgtcccaaagagggaacaggaacatgccttaatagcattcttttagcatattctcttttctcgtaaatcgtgatattagatcttctttggtaataagactcttccttaatctttatcggatattctgtgctgatacgaaaaacgtccttatccatgaaacggatttgctcgggattcttgaagctaatattttccggtccattatcctccataaaaatatccattgacgcattttctggattacgaggtatcaagataaaatcccaataggcttcttttgtgtgataatggatttctttctgtattgggcatttcgtttctaataattctttggtaacatgaatgatcacattgagccgattcagtcggttatcgataacacttaattgtatatctgaatcatttagctcttccggtagcagggattgtgtatacagtaaaaaattcggatcttttgaatgtgcttgaaactcaaggttgagaccatccggggagattgaaaggtgatcaagaagctcttctcgatctccaattagtgcatattgatttcgccccgtttgcctaaaaggatatttaggtcctcctaatacgactctattcgttctcctgggttctatctcgaagatttcagaaggaatacattcattataatattcatggctaaatataatgttaattaaaaagtcaaatttcatcattggtttgttttatcgttataatattccaaaagtagataaaaagaatatggcatgatattaaatgctatatgtttgataacattatttctaatttattttttgacttgatattcgttgttttatatccttgatttctgttccgtcaaaagatatgattcgtgctttacataggattgatggataataatgccctcctaatatactccatatattgctgagttcttgcatactaattgttatgggctcgagcgttatggtaccttggtctggtaatttaagaatggaattttgttgtaagaaggagattgaatccgataatatttgtatagattctaagtatcttttagatgaaaaaacagcggcaaccataatatatatattcaagtaccatggtggagatgtttgttggaatgtgttattttttgtgttcctatagggggcagagattcccattgctgtctctcgctctatattcacgatagaaagtatgattttatccgattgatcctcatttggagtcgcatcaatacttccggcttccactataatttctgcccgttcataatagctggaaagaaattcgttcattttctctgcgagtgtgtttattaatacgtgtatcatggtcttttgctttatttgtgctaaaggtaaggaataaatttgtttttctgctttataatttcattgtctgaattctttctagcaaattaccttcgtttcgattcgtgataagaattaaaatcgttttttgattgtcatagataattacgtcttggcggtttcctgaaaaagattgaaagaaaagttgatcctgagattgggctatgcttattgtgtattttttatctactcttattttctattatgtgacttcggaaaaacacgtacgacttttttcgaaaacacgtacgacttttctcatgaacatgtacgactttccggtaaaacataatcgtgtttttaagctgttaatgttcagtgatttatatttttgtatcattcacgcacttattgtatggaaaattatcacatcgccactcaataaatcatatatacctccatgtagaagtgcggcacgctatgtctctataacaggatgtctccaatagggtgagaatcgagtagtatggctttatcacacgtacattatataacttgttaagtcttgaaaaaaaacttgaaaaataatgctgaaaatgtttggaggttatgttttatagcactacttttgcacccgcattcgagagagaacgccggtataaaatgatgaaacaaacttttagaaaaaaaagttccggaataatttggaagtttaaaataaaagtctttatctttgcagccacgttcgcaaaacgaaagcgacaaaagagttctttgagagatttacataattcaacaagtagtacaagtataggagaagaaattttccggatcgataccgtcaatagaagtatgactttggactacaataacggattccggagcgaggatatgataaaacaatttaaacaacgaagagtttgatcctggctcaggatgaacgctagcgacaggcttaacacatgcaagtcgaggggcagcgggggtagcgatacccgccggcgaccggcgcacgggtgagtaacgcgtatgcaacttgcctatcagagggggataacccggcgaaagtcggactaataccgcatgaagcaggggccccgcatgggggtatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacattgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtaaagctgaggactctggtgggactgccagcgtaagctgcgaggaaggcggggatgacgtcaaatcagcacggcccttacatccggggcgacacacgtgttacaatggcgtggacaaagggaagccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgaaaggatcggcctagggtaaaactggtgactggggctaagtcgtaacaaggtagccgtaccggaaggtgcggctggaacacctcctttctggagctttaggattccgtaccgaggtcatacgaggtatcgatcgccttgtgctgctgttgagattatgtttattatatagatcaatgaccggaaggccggtcggagagaaaaagatgacgctgggacgtaagtcttggcaaagttgacagtcctatagctcagttggttagagcgctacactgataatgtagaggtcggcagttcaactctgcctgggactactccgaatgaggggggattagctcagctggctagagcatctgctttgcacgcagagggtcaacggttcgaatccgttattctccacacatcccgcgagggaaagaggatctttgacatgttggacatcaaaaagaagaaacaagtagagcgagcttaagatatatcaacccgtacgtcaagtacgaggtgagagaaagtaagcaagggcagacggtggatgccttggctctcggaggcgacgaaggacgtgataagctgcgaaaagcccgggggaggcgcaaatagcccttgatcccgggatatccgaatggggcaacccggcaggctgaaggcctgccatcccgaaagggaggcgaacgtggggaactgaaacatctaagtacccataggaggagaaaataaacaatgattccgtaagtagtggcgagcgaacacggaagagcccaaacccatgtcgtctaggcgacacgggggttgtaggaccacgacgtggcaagatagagtcaagtggaacgccttggaaaaggcggtcatagagggtgaaaaccccgtacacgactgacgattgaagcctagtggcatcctgagtagcgcggggcacgagaaatcttgcgtgaattagcggggcccatcccgtaaggctaaatactcccgagagaccgatagcgaaccagtaccgtgagggaaaggtgaaaagaaccccgagcaggggagtgaaatagaccctgaacccgtctgcctacaagcggtcggagcgtcgtaatgacgtgacggcgtgccttttgcataatgaacctacgagttaccttccccggcaaggttaagttcttgaggaacggagccgaagcgaaagcgagtctgaacagggcgccaagtcggggggggtagacgcgaaaccgagtgatctacccttggccaggttgaaggttgggtaacaccaactggaggaccggatgggtaagcgttgaaaagctttccaatgagctgagggtaggggtgaaaggctaatcaaactcggagatagctcgtactccccgaaatgcatttaggtgcagcctctttatagtatatcgtgaggtagagcgactgattggatgcgagggcttcaccgcctatcaagtccagataaactccgaatgcgcgatatatatttacagggagtgagggcgcgggtgctaaggtccgtgtccgagaggagaagaatccagaccaccggctaaggcccccaaatgatcgttaagttgaactaacgaggtcggatcgcagagacagctaggatgttggcttggaagcagccattcatttaaagagtgcgtaacagctcactagtcgagcgatctggcgtggataataatcgggcataaacgatctgccgaagccgtggatgtcgcaagacatggtaggggagcattccatgccgcgtcgaagatgagggatgacccttgttggagcgcatggaaaagcaaatgtaggtatgagtaacgataaggggggcgagaaacccccccgccgaaagaccaaggtttcctgatcaacgctaatcggatcagggtgagtcgggacctaaggcaaagccgaacggcgccgccgatggaagaatgggttaatattcccatactgcctcatggagtgacgtggagacggagaagtgacagtcctgccggctgacggaatagccggttgaagggtgtaggtgtcgatcgcggtaggcaaatccgccgcgagagccgaacctgacagtatacggagcgcttgcgcgacgtaatatggacgtaaccatgctcccaagaaaatccgctaaacttatccatgcggcacccgtaccgtaaacggacacacgtggtcgggttgagaatactgaggcgctcgagtgattcacggttaaggaactaggcaaattgaccctgtaacttcgggataaagggtcctcgtcgtaaggcgaggcgcagagaataggtccaggcaactgtttaacaaaaacacatggctgtgctaaatggaaacatgatgtatacagcctgacacctgcccggtgccggaaggttaagaggagatgtcatccgcgaggagaagcgttgaattgaagccccggtaaacggcggccgtaactataacggtcctaaggtagcgaaattccttgtcgggtaagttccgacctgcacgaatggtgtaatgatctggacactgtctcaaccgtgagctcggtgaaattgtagtatcggtgaagatgccgattacccgcgatgggacgaaaagaccccgtgaacctttactatagctttacattgagtttgggcagacgatgtgtaggataggccggaggctttgaagggggtacgccagtatccttggagccgccgttgaaatacggcccttcggttgtttgagttctaactcccggacgggaggacactgtatggtgggtagtttgactggggtggtcgcctccaaaagcgtaacggaggcttctaaaggtgccctcagaccgattggtaaccggtcgcagagtgtaatggcataagggcgcttgactgggagagatacaactcgatcaggtaggaaactagagcatagtgatccggtggttccgcatggaagggccatcgctcaaaggataaaaggtactccggggataacaggctgatcattcccaagagctcatatcgacggaatggtttggcacctcgatgtcggctcgtcacatcctggggctggagaaggtcccaagggttgggctgttcgcccattaaagtggcacgcgagctgggttcagaacgtcgtgagacagttcggtctctatctatcgtgggcgcaggagatttgaggggctctgacactagtacgagaggaccgtgttggacgtaccactggtttaccggttgtcccgccaggggcaccgccgggtatctaagtacggatcggataagtgctgaaagcatctaagtacgaagccggcctcaagattagatctcccttaagggtggttatagacgatgaccttgataggccacaggtgtaagggcggcgacgtccgagccgagtggtactaatagcccgggactttcctcacgtgagggttgatatattttaagacgataaggcgaagctggtctcttcggattgatgtccggtcaaaatcttgataatgaaattaaggtggctatagcacgagggatccacctcttcccattccgaacagagaagttaagcctcgtcacgccgatggtactgcgtaacagtggaagagtaggtagccgccgtcttgaagaaggcgatagccgatggagaggagtcagtccgtaaggggtgactcctttttctgttatatacaccagccgtcgtagagacctagcgtgccgcatctcgtatcgtctgacgatattctaagttaccatttgaagggatgagacgctgcacgctacgtctctacaattgggtgagatttcattgtttgctgaatcgggaacaataaagttcgtatcttgccgttatattaagaattcaccgaatgattctgatttatgagcagcatatatgattctcgtcaaagatggaaattaggctttatttttgccgctgtattgatcgctatggcttctgtggtagtctcggatctcttgattaaagatctggcccgagaagagcgtcagaagatcgaggtttggagtgaggcaacccgggtcatgaccagtgagaatccaagccttaatatgaatcttatcctaaaaatcatccaagggaatacttctattcctgttatattatgcagcgagacggatagcgtggtttcttacaataatatagagattccggaaaagaatgtagcgcagttcatgacgaataaggttaaggaactgagaaccaaaaatcctccgatcgtaattgacatggaggatggtacttaccaatatttatattacgatgattcgattatcttaaagcgactgcttgtttatccctatgcgcaattatcagttgtatttgtttttatattaatcgcttttttagccttggctagtacaaagaaggcagaacagaataaagtgtgggtggggttatcgaaagagacggctcaccaattaggaacgcctatatcctcgctaatcgcttgggttgaatatttgcgaacgaaagatatagatccttctctattgacagagatggataaggatgtgaaacgcttacaaacgatagcggagcgtttctctaaaatcggttcagatccggatccggttccgacaaatatcgtggaatccatccgtgcggctttgggatatatggagacccgtatttcctcgaaggtgaaaattaatacgtatttgccggagcggccgatattggtcttaatgaatgattccctgttcgcttgggtaatcgagaacctgacgaaaaatgcggtggacgctatggaggggcagggtgagatttcgctaaaagtagaggaaagagagaaggtcgtgctgatcgatttggctgataccggaaaaggtatcccgaaatcaaaattcaagacggttttcaatccggggtatacgaccaagaaacgtggctggggactaggcttgtccttggtaaagcgtattatcgagtccttccaaggaggaaagattttcgtgaagagttcggagctggggaaagggacgacttttcgtataaaattgaagaaatataagggttaaatcgtattataggaaaaaataagcataaaggtattgtttttgtatttagttttttcgtacctttgcaaggtttttacactaaaaggctttggggaaatttaaattatataatgtagatttgaaaaatctctctccgggagtacacgaattcgagtatcttttggagaacaagttttttgtggacattgacggaaccgaggtccagaagggcaaagtgaaggttcatcttaccgtaaaacggtcgtcaatgatgtttgagatgaactttcagatagaaggggttgttgttgttccatgcgatagatgcttggacgatatggaaattcctattgatacccacaatcgtctggtggtaaaattcggcaaggaatatgccgaggaaagtgatgaggttgtcgtgataccggaagaggagggcgctattaatttggcgtggttcctgtatgagtttatcgctttggcggttcccatgaagcatgtacatgcgccgggtaaatgtaataaggcaatgtcgtctaaattgaagaaacataccgccagaagttcggatgagaccgaagacgattttgaggatgacatgggaggtgatgatttggcgttggaagatgacggaaacgctagtcctgccgatcctcgttgggatgctctgaaaggtttgctagagaatgataacaattaaataaataaaacaatggcacatcctaaaagaagacaaggtaagacaagaacagccaagagaagaactcatgacaaggctgtagctccaacaatggcaatttgcccgaactgtggcgcatggcacatctatcacacagtatgtggtgagtgcggttattacagaggtaaattagcgattgaaaaagaagctgctgtgtaagtttgtcaacttatatggtttgatgaacaaaagaaatagccctaaaagtttttttagggcttttttttaattgggataagtagtccttttatttttaaagttatggataagataaatgcggttatcacaggagtgggtggatacgttcctgaagatgtattgacgaatgaggatatttccaagatggtcgatacgacggatgagtggatcatgactcgtgtgggtattaaggagcgcaggatattgaaaggggagggcgtaggactctcttacatgggtatacgggccgtgaagcaattgctcgagaaaacgaacctgaatccggaagaagtagaggttgtcttgaccgctacgactaccccggatcatcatttcccgacaacttcttctatcatcgcttatcatacaggttgtaagaatgcgatgacttttgatatgcaaggtgcgtgcgcaggcttcttgtatgctttggagacgggcgctaattatattcgctcggggcgttataagaaggtggttgtcgtatcgggtgataagatgacatctattacagattatcaagatcgttctacttgtcctttgttcggggatgcttgcggagcggtcttgctggagccaactaccgaggagttcggtgtcttggatactattttacggacagacggcgtaggctatccgcatctgatcatgaaatcgggcggctcggcttatcctccttctcacgagacggtggacaaccgtgagcatttcgtttatcaagatggacgtgtggtgttcaagtacgcggtttcttatatggcggacgtggccgctgagatcgcggagaagaatggcttgacgcatgatgatatcgcgtggatcgttcctcaccaagcgaacctgcggattatcgacgctacggcgaaacgcttgggcgtagatatggataaggtgatgatcaatatccagaaatatggcaacacaagcgccggtacgattcctatttgtctatgggaatgggagaatcaattgaaaaaaggagataacctgatccttgccgcttttggagcgggctttacgtggggagcggtttatctgaaatgggggtatgatggaaaaaaagcataaatcgggttttgtcaatatcgttggaaacccaaacgtaggtaagtctacgttgatgaatcgtttggtcggggagcggatctctattatcacctcgaaggcgcaaacgacaaggcatcgtattatgggtatcgtgaataccgacgatatgcaaatcgtgtattctgacacgccgggagtcttgcggccgaattataagttgcaggaatccatgcttaatttctctcaatccgccttaggcgacgccgacgtgctgttgtacgtgacggatgtcgtcgagacgattgataaaaataacgagttcctagcacgggtacagagcatagagtgtccggttctcttgttgatcaataagatcgaccagaccaatcagccggagctggagaagctcgtggcccagtggaaggaattgcttccgaaggccgagatcatcccgatctccgcgctttcgaatttcaatatagattacgtgaagcgtcgggtggaggagttgatgcctgattccccgccttatttcgagaaagacgccttgaccgataaaccggcccgtttcttcgtgacagagatcattcgtgagaaaatcttgttatattatcagaaggaaataccttacgcagtagaagtggtcgtcgagttgttcaaggaagatgatgagctgatccatatcaaggcgctgatcatcgtggagcgtgatacccagaaggggattatcatcgggcatcaagggcaagcattgaagaaagtaggtgctatggcccggaaggatatcgaacgtttcttcggaaagaaggtgtttttggaaatgtttgtcaaagtggaaaaagactggcgtaaccgtgacaacatattgaagaacttcggttatcagctggactaataatagcatacgaaaggagaatttatgggaaatatagtagcgatagtggggagacccaatgtaggtaagtcaacccttttcaaccggttgacgggtacccgtcaggcgatcgtgaacgaggaggctggtactacccgcgaccgtcagtacggcaaggtggagtggaccggcaaggagttttcgctgattgacacaggcggatgggtggttaactcggaggatgttttcgaggaggagatcaacaagcaggtaaaagtggccatcgaggaggcggacgtgatcttgttcgtcgtcgatgtattgaacggcatcacggatctggacatggaggtggcgcagatcttgcgccgttgcaagcggccggtgatcgtggtggcgaacaaggcggataattatgatctgcatccggcctcggcggagttttactcgtttggcttgggagatcctttctgcatctcggccatcaatggttcttataccggggatttgctggataagatcgtggcgacgttgcccgaggagaaggtggagatactggaggaggagttgccccgtatcgcgattataggacgcccgaacgcgggaaaatcttctcttatcaatgcttttattggcgaggatcggcatatcgttaccgatatcgcgggcacgacccgtgattccatctacacgaaatataataaattcggcttgaacttctatttggtggatacggcgggtatccgtaagaaggggaaggtgaatgaggacttggagtattactcggtgatccgttcgatccgcgcgatcgagaactcggatgtttgcgtgctgatgttggacgctacgaggggcattgagagccaggatatgaatatcttctcgctggtgcagaagaataagaagggattggtggtttgtgtgaataagtgggacttgatcgaagataagagccagaaggtgatcgactcgtatacgaccgctatccgcgagcgtctggctccgtttaccgacttcccgatcttgtttatctccgctctgacgaaacaacgtatcctgaaggtgctggagaccgccaaggaggtttacgagaatcgctccaagcgtgtccctacggccaagctgaacgaggtgatgcttccgatcatcgagaattatcctcccccagcatggaagggtaagtatatcaagatcaaatatatcacccagctcccggcgggcagcgtgccttctttcgtgttcttctgtaacttgccgcaatggatcaaggacccgtacaaacgtttccttgagaacaagatccgcgagaactgggattttaccggtacgccgattaatatatttatccgggaaaagtaaatactagatacaaaaaagccgcttcctgtaacggggaggcggctttttctatttagaataggtcggaatgcgttccgatatcggtgaaaagcaagattagctccgtgtcatcttggctccatatcagcagccagtctccttggatatggcattcccacaatcctgcgtatttcccggatagcttatgcgggtggtattgggagggaagggaaccggtatttttgaggatttctacagtctctaataagaggtttatatccaagtgccgcttcttgcaccgcttgatgtcacgttcgaatttggaagtggtatgtacggtataagtcatagctctagcattttttgcttgaatgcctcaaagttctcgtatttgtgtatccttcctgccttcacgtcctccaaggcctcgtccaatccggatttcttctgtgccttcaccttgccttccagcgaagtgatgaatttcttcaagatgtcggcgtatttctcggggatggttacctcgaatgtctttaatgatgtcgttgtctccatatcgctctgttttaggaatttccttcgcgaatatacggaataaaaagagaaggggaattgttttccttctctttttatttcccgcttccgcgtcgggagggagggacgtgacggttagatctcgtccgggctctcggagtctccgccgggcgtaggctcgggtgtaggctcgggagcgggcgccggtttcttggaggcggccatgcgctggttgtaggcggcggtggtctcggcgatcagctggttgagggcggcgatgaaggcggtcgctttctcggacggcttcgctatgctatgggactgggccagcagggtgagatcgtcataatacatgtcgatccgcttgcgcaggttggcgccgctttcctttttggaggtggtccggttttggacgcgttgctgcgacaggcggtcgtaggcgttattctctttctccagttcggcgaggtaagcgtcgaggccgagcgtggtgacgtacggcttgttctcgtccttgcgcaaatccagcaagaggccctttatcttggcggtctcctgcgccatggggaggcgggcgaccccgttatagggcttgatgaccttgtatagatacttgcccgcgtcacgctcggcctccaacgggagggtaccggcccgtgagatgcgggtgatgatatagatagcgaggttgtcgcggttggtatcgtgcaaggtcatttgctcggtctcctgcgaggtgcggctctcgtccaccacgtcggccatggcgaggaggtctgcctcgtaggtctcgaggaattctttggtgaggcccagctcggggatgccgtcgttgccggtcagcagggagatctcgtcgggggactcggaatcgccgtcaccgctatttccgttggctaggtcgaggacgtggttcatgaaggagaggtactcggcgttgttgaaaagagagagcggaagtgtcttgatttttgtgtaagtactcatggtaaatttgatttagagtttaaaaacttctctaagttagggatatttgctgaataagggcttcttaggtctaaaaaatggggattgaatggcgcgaataatcatcttagccctaagaagtcatttttcacccttcgagggcatttcttagggctaagagacattaagaatctgattgttttgcgaatgttttaaaaaaacacgatcttcgcgacgtattggaaaaataacgtagaagcgtttcgatattatcttgtactggaatctggacaatttcattacccaagataataggaaaatggctcctgcgctttatctgttatatacctacccattcatggatagattatatacctgcataaggcgtgggatcattgtcttattattgggtaagggcagtccagagcctcagtacagtgatagacaatggtctccacgcttcttttatttgttaaccgcctaccggaggaggcacgggaggaagaatgtgataaagatatgagaaaattggtttatttgttaggtttattattttttatggcctgtggagaagatgctaaagagggaattattcctgaacctgatgttccttatgattatagtgagttcggcggctatcatgtgaaggatactgtcggttacgatatggcgacgcttgagttttactcatctaatgatacggcttggatttatgcgattaaaggtcaaaaggtgtggtttggtatgttcaatgacaatacgaaagaacaaattacggaatggaaggcctcctcaagtgaggaatcagactacaccagttcatttcttggtaatccatttaaggtaggagataaatatgtatgtttcatgaagattgctcctgagttatataaaccttttttgttgaaagaggaaagcgctatctctcttaaagaacgagaagccagttggggaagtgagaactttttttcagttagagagtttggagagaatatattggtttatcatcctcatttttatggtaacctattatattcatcagaaggagttgaggtcataaattctgtggcttttcaggatgatcctgaatctgataatgagtatttatcaggttttaagaatgataaagtgtggtttggtatatacgaaaatggtgaattgcgagaagaatatacgggcgagaatgtttatgatagaaatataaagatcaataaaggatatggcgaatacgaggaatattttgtgaaggccttgtctttcggttattcgagcggtttgttgaaaacagaatgggggtatgtattttatcctacgatcaaagattctgaaagtggtggttatattcatgatatgtttttttgtaatggagggaaaatgtttccggtctttgttggaacatattatttagatataaggaattggtatgatggaagtgttctaatgggtaacaaagtagtcttctctccggaaggtaagaggctgatagaatttgaagataatgatctaggagatgataggatgttgagtgtattttgtaaagaacctagttcttatactcatataataaggttgatgcatgcaaggatgtgggctgattatacggtggttactatcgacaaatatgatttggaatcaaagaattctctttggagcgtgaatgtggatgcgctgggagaatgtgctgtgaatagtaaatttgttgctaaggtattgggaaaagataaaaatatttggacgatggaagtgtctgtgatatcatttgaaggacaagaaaagatctcgaattttaagttgaatacggatacgggtgagattatctatttataatcattatctgtgataagatccttttaacggattagtgaaaatatctatatgaccataaaaccttctccgtcaaatcttattgtatgaaatggagaaggttttatagttccatatattttatttttccaatatccctatcatgccccccttcagcaccgggatatggtttatgataagcgtccaaagaaaatcgggatcgatctttagtatcctattttggcctaccctcaaagtaactctcagtctcttcgatagaaagtagcacatcataaagatgtttctcgatatattcatccatagatcagcaattttgtattatcaatattctttcttaggatcgggttccggatcgacttgtcctctagcaagtcgatctcccggtggaagatggcagataaggcgttgcgcagatcgaagaaattattcacgtaattcacctgttccacctctttgtcgaaatccaccacaagatcaatatcgctcttctccgtgaagcggttcgtgaggacgaaacctgaagcgaaccgccggccttgtcttaagcctccaccccattcctgtacaagtaatccggagcgaaatctgccccattgtaccattcgagcgcccagtgtgtgagcccgaactggacgaaattccggaggtctttcaatggctcgaaaagtttccctttcagtaaagggaggaagttcactaatttcaccttaccgttgctaaattccaatcgcatggtatagccctttacatattccacgccagtgacgcgtattaaatctatatcttcagtcataactttttctcttttaaatgggtcttaggggattttcatcacgaatatatggaataaaaaagataagggtacgagttcgcctctcttttttgtctttctttcatccacatttccttgaaacccttggaatccccatttataatcgtacctttatgtctctttaccttaaaaattaaaaataatcatgtttacgccatcaatgacaaacgaggaaatagaggcagtggcctataaggactttctggagatccggggaagagtggaaatcgcgaaggataaattcgtacaaagggtgagatgcacgcccccgggattttgggccttgcattccttgcaggagacacatacccttcaaacccgctccaagaatacatggactgtatatttctattatttgtacacgacaccggccggtgccgtgaaagtctcatctatgatctacacctccctgccgggagatgaaggcacggattacctgtttatgaataatctcgaccgctttcggctggagagggtgagctcgcgtttctcgcgacaatacgaggaacgctatatcgacccgaaccagatccaactgaacggccttctgcccgctatctatttcatgaggactgccggcgaccggaagatcgctccctacactcccgatacatggaccgaggaagagaaaaaggacaaatatctcttcgtgtcggagcaagggaccatggaggcgaagctggaggggcgtgtggagacctaccttactttcttagagccggaacagccgggtgattaataagtagagggcgaggttgataccccgccctcccgataactaggtagatacctccgggcttatcttttcagaagatcgatcctctcgccgggcaacagtaccgcatgaaccttctccgttacccgccccttcacgttgaaggaatcccttaggcggatgtcgtcggcggaggagccaatctgcgcctcatatttaccggactctacgacccaatgactggcgctctcgtcgaaggaggccagatccgtatctttcaccttgaagatgatctcacggctctcccccggctggaggagttgggtcttgacgaaacctctcaactctttcgccggcttatccatgctcttgccgggggcggagatatatagctggaccacttccttcccggctaccgggccattgttcgtgatcgtgcaactgatgctgtagtccgtatcgcccatgaacactttcaagctcgaataattgaaagttgtatacgactgtccgtagccaaacggataggagacgggcacgccgaacgtatcgaagtaacggtagcccacgtagataccctcctcgtagttggtatagtcaatattcttacgatccgtatgctccgggcctcctcccatgaaaccggctaacatttctttcaggtcgatatccgaagcgtccgggaaattcttcgtggaggctacgtcggcgatgctcacggggaaagtcatcgggagcttaccggaaggattcacctttccggacaggatatcggctaccgtgttacccccttcctgcccggcttgccaagccaataggatggcgtccggttccgatttccagctggcggtctcgatcacgcctccgatattcaagattacgaccaccttcttcccttccttatggaaagcgtcggaaaccgattggatcaacgctcgctcattctccgtcaggttgaaatctccctcgatcttccggtcttggaactctcccgagctacggcctatcgtaacgaaggcgatatccgcctctttcgccttagcggccagccctgcggcatccggtacgaactccgggatacgagggtggttgaagaaagcggcggcgggactcgtgtctttcggctgtttcgccttttcctcggtactgtatttctcgtataaggctttcacttcggcgtccatggtataaccggcgttctccagaccttccacgagggatacggtataagccttgttcacgtcgccgctgccggtgcctccggcgataaaatcgtacgaggtggtaccgtaagccgctatcttcttgatacccggggccagcggcaaggcattattcgtattctttaataaaaccataccttcggaagcggacgcacgggttacctcggcgtgagctttcaggtccggtttgtcggaatgggcgtattgggcaaagcggggggcttgaagaatcagtcgtaatacacgggttacgtccgtatccacgtcgtcgatagagagagaaccgtcctcaagcgcttttaggagggcctctttctggtctggccggccgggcatcagcagatcgtttccggcgtggatctgggcgggggcgttcttgccgccaaaccagtcggtcatgacaaggccgctaaaaccccattcgtcacggaggatggtcgttagcaaatcacggctttcggaggcatactcaccatttatcttattgtaggaagacatgaccgtccacgggcttgcctcttttacgaccatctcgaaacctcttaggtaaatctcccgcaaggcacgaggggtgaggcgggcatccgttcccgtccggttggtctcttgattattgacggcaaaatgcttgatggaggttcccacgccattgctttggataccgtttaccatcgctgtcgctatccggcccgtcaagtagggatcttcggaataatactcgaagttacgtccgcagagagggcttcggtggatattcagcgcaggggccaagagtacgtcgcaaccgtattctttcacctcgtcgcccatggcgttgcctacgtttttgaccaatgcggtgttccatgtggaggctagcaaggtagcgaccgggaatgccgtgcaataataggtcgcctcgttcccctcgcgagtcggggagatacgtaatccggcgggaccgtcggccactacgatagcggggattcccagacgttcgatcgggaaggtcgttccggcggctcccggcactatattttgcgtgctgccgactacggctgattggccgccgaacccgggcattccggttccgactaacagggatactttctcttcggcagtcatggcggctacgattttctcgataggatctttacccaattgcggcaaggtttgggagtgccctacttgcatggccatcgtaaggcatgtgcccattaatagtttgttcatatagaatggtttttgtgtttttcagtgccccaaaaataggcgaaggaatcgaggcggacaaagaaaaagaaaggtatcggaggtaaggatttcgttttttgatgaatatcaaacattgtaggggcttgatgatatatttaggggacgcagactgcgtgctctgcgtagtctgcgtcctgtactatttataatgtattcagaagtttatgaatctcattaaccatctgcgtagcggattcttgtgtctcggataaaccttccggagtgatcttggcaaccgtcttgttcaacttctcgagtttgcctttagctcctttcgttgtcagctcttcccggaggatgcggatcttctcgcaatcttgtataccctcgaccaaacgttcgaagcgaatgctactgcgtggaccgggataaatactgtatgtatcgcctgccgcccaagtgcggaaacgcgagtcacgcagaggatcggcggtccagctattaactgcccaacgtagataaccgtcgtaaccaccggctacggcgtgcaagaccgtccacgccgcttccgccggatcggagaaggtaaaggtattcgggaacgcttctgcgcaacaggtataaacggtactgatctgtcccgctttatcacgggcagcctttacgtcttctgggaatttatgtccatagggaatacttaaatagtataagtccgattgaatttccggatgataatttccggccagcgtgatcttgaactccggatcggcttgcttgataaccttgatcgcctcacgcatcgcttccatcggacgctcgtccatagagatagcggttttctcgaaccagcctttctcgcgaaggtggcgggagaaatcttttaggaaagtaccccaatagtctgcgtaagcggcgtcacccggtttagtgttgaggaattgtacacgatttgtcgcctcgtcgtaataatcgaaagataaagcccaagggatcatggtgtagcaactgatcatatcattgataccgatctcgttcatcatgaattccacccatttgtcgaagacggcgtaatcatatgcccaagtgccgtctatcttcttgatccgggtgatcatgctgtcgaaatgatcctcggtttgtccggcccaaggtttatgcatgatactggtggtgatagcgcgctgtccggcgttcgccagcattttcatgatcgggcgcatagcgtcgaaatgttctttgctccaaagaggaacttggtagtaacgggccacggaatacgggttctgccataagtccagatggaaagcccagtccttcggggcgggaagtgtgcggttcaatacgtccacttctatttgtaattccatgggggaggtattttttcccgtgacggtcaatgtccctttatatttaccggctttcgcggattgaggtacccagatattcatccagatcggctgggtggtgcgtgccttgatatcacggatctttacgatatccaatacatcggctacgacggaggaatcccattccgccttattctctcggtggccgcaaccgcctttacggtctttattcaactcatcggtcatgacgtaacggacaaagttcgtcgtgatcgcggaggatgggatgatggaagaaccgctcttcaagtcgctcacggtgatagaggcatcctcgagtcccaccttggtccataacacggcttgcgcgtttacccgttcccctttccatgctttcgtctgccagcgattgcttttcttgacatcgggaatactgagtttcggatatcgtatatcggtcgtaccccagcttaattgggttggggccgataacttgtcccagatctcgtcgctgtcatgcggtttcgtgtcggtcaattccgtatagtcgcctagcgggtatttctcggattgctgggctacggtaaaagaacttagtgccagaaaggcacaaaggatgaaagtgtttttcatacgattgcttattttagaatattaactagggcaaagataggaattaattgtcacttgtcaactaacctcttgtagtggcatacgagcagattcccctcatcatcgtataagtgcatgccgttgccctcgcaataacggaacatcttacaatccgcgcattccccttttttagcccactggcggttacgatacggtttaaactcattattccagatatcaatgaaatcgtctttatagatgttcccttggtggaagttcgcccgtatactgggacaaccggagatagcgccatcagcgaggacagaggccgtattgataccggcgttgcattggaaaatcgagtctctcacctctgcctcataattcccgaggaagccctcacagccgtagctaacgtgtatcttaccctctttccggcagaagcggatgaagttcatgacccatgtgaactgttcgttcgtcagttgcaaatcggtctcagtcgcggcacgtccaactgggaagatcgtaaagatacgccaccgttttacgcccatctcgatcaaaaaatccttgaagagcatcaaatccttgaagttgtgttggtttacgcaagtcaccacatcccagatgatctccttttcctcggccaacatacagatggcattcagtgccttctcgaaacttttaagattacggcgaagccagttatgcgcttcctcgaaaccatccaagctgatagttgccgagtgcaatccggaagccaagagcgagtcgagccgttcccgggtcatcagataaccattggagacgatcccccaaggatatcccctgcgatacagttccagcccgcatttctcgatatccttacgaatcaacgcctcgcctccggtaaagatgacgagtactttgttcggctcgacataaggcgtgatatcgtctatgactttcaggaagtcctcgacaggcatatccgggacagaggccgagacatggcaatcgctcccgcaatgacggcaggatacattacaacgaagcgtacactcccaaaagagtgtacgcaattcatgtaatttagccctgttcttcttgatacttcgaaaaagctctagggcgatacgttttttgatgtttgggcgtttgtccatattttattcttttttctctttaagtttgatgtcggggatgttaacctccgctttcccatggaaccaagatttacctccctcaaatccttcgatcttgacatctatcgaatccgtctcgaatgatccgttttcaggcccgtcaatatctttagcgataatgcgtacgatgcccattggggaatcctcgaattttatatcgtaacttccgtctttttgggtttggggcgatttatacatctcgcttatatatgaggaaaataatacgttattatatatgcctccatagttgagctctattccttggatgggatctccgttcatatttgtaacttttcctttcaactcgtattctgcgtaagggctaccatactcatctgtagcgccacaggaagtaacgctgaagcctagtagagaaagaagccccgctaaaatccagttaaaaccttttaatatggaatgatacactgttcccattttctagtttttgcgtgttagttggaagttaatttcttttgatcctttacccattaacatccctttcccttgtgataattcaatttcggcgaaatttacgatatagaatcagttttgcaagcgtttgggtcattccaatacgaagataattttgtgtagatggtatgttcgattgtcgtagccttatcgtaggtgaattgatatcgtccggtctcatccgtgatagccggaaagctggaaaggtcgtcctcttgagtaggggtatatgccggtgaggttaagattgcgactccggccagcggataaccttgatcatcagttacttttccgtagatcgtgtataatgcgtaaggttccgtatgtgtatctacatattccttaagtgtgatcttgatttcctttgaggcgctaccttcgtaccatctatcgcctccagtaagttcctcgctgtcgaagattacttgagtcgtatcggatgcgaattgtcctccgttcatttcttcatctatgtcttccgtgatgaatcggtattttaggattggaaaatcagttttcttccaatcaaactctccgttagcgtcggtccttacggtatcggtatgcagccatccgtaaggataaattcttgcgtcatttcgattgatacgtatttgggcgttaggtatcggatgatcgtttgtatccacgacttttccttttatctgaaaattggcgtaaggagtgccatattcacaaattatgggaccttctccctcgtcgtcagtgcaggagaaacctaaaagcattaataaactcgccaatacgcagttggcttttttcaacaattgcaagtgcatccttttcatggtgtaaattatttttatttacgattctatttatttgatgaatggggcagcaaaatagttgcatgcgaatgcgtaagaaaatgtgatgactttttgtatctttgccacttcaatgtaacagatcaatttatgagagatttcatacgtattttaaagcgtttcgttcccccttacaaaaagtatatggttctgaacatcgtgttcaatgtactttccgctatcttgaacctgttttctttcgccttgattatcccgatccttcagatcttgtttaagatggatgaggggaattacacctttatggattggaattttaacgcgggaagctgggagtcgtggaaagccttgccggagttgatcaaaaataactttttttggtatgtatccgatctgatagaggtacacggaggttcgttcgccttgattatgttgggaatcttcctgatcgtggcgactttcttgaaagtggcgaccatgtatctggccttttatacgatgatcccgattcgaaccggagtcgttcgtgatatccgtaatcagattaacaagaagattacgcagttgccgttgagctttttctcggaggagcgaaaaggggatattatcgcccgtgtatccggagacgtgaacgagattgagacatccatcatgagttcattggacatgttattcaagaacccgatcctgatcgtgatctatctggtgggtatgatcgctatcagttggcaacttaccgtgttcgtcttgatcctgctgccgttggcgggttacgtaatgggacaagtcggcaagaaattaaaacggaagtctttggaaggacagcaacaatggggattcctgatgagccagatcgaggagacattaggcggactccgtattatcaaggcctttaacgccgagaagaagatacaagaccgctttgagcgaagcaatgatactttccgccggttgacgaaccgtatctatcgccgccaacaaatggcgcatccgatgagcgagtttttgggaaccgttacgatcgctatcgtactttggtatggaggtacgctgatcttgagcgcgaatagcccgatcgacgctcctacgtttatttattatctggttattttctatagcattatcaatcccgcgaaagatctaagtaagtcggtttatgcgatccagaaaggtctggcctctatggagcgtgtcgataagatcttgaaggcggagacggatatccatgacccggaacatccgaagaagatcgccttgaaagagaaaatcagttataaagatgtttggtttaaatatcaggaagcttgggtcttgaaaggaatcaatctggatatccggaaaggaacaaccgtggctttggtcggtcaatccggttcgggtaaaagtaccttggtggatctattgcctcgcttttatgatgtgaataaagggaatatccgtattgatgatacggatatccgtgaggccacccttttcgatcttaggggattgatgggaaatgtcaatcaagaggctatcttgtttaacgataccttcttcaacaatatcgcttttggagtggaaggggctacgatggaacaggtggaggaagccgcccgcatcgccaacgctcacgattttatcatagcgagtgagaaaggttacgataccaatatcggcgaccggggtggaaaactgtccggcggacaacgccagcgaatcagtatcgcccgtgcgatcttgaagaatcccccgatcttgatcttggatgaggccacatccgccttggatacggaatccgagcgtttggtacaagaagcgttggagaacttgatgaagaaccgtacgaccgtagtgatcgcccaccgtctctccacgatccgtaacgcggatgagatctgtgtgatgcatgagggtgagatcgtagaacggggcaaacacgaggagttgttggctttggatggctattataaacgactatgtgatatgcaaagcttttagggtgatactgcaacccgggttgcagtggatcgcctcttcggcttttgatggaaaaacaataacaaggaataatcgtatgaatatgaaaggactttatttgattttgttatcgttccttttcggttgtaatttaccggatatgcagaccgggaaggaggtctcttattattttgaccaaccagcgcagatatgggaagaaaccttgcctttgggaaacggccgtatcggtatgatgccggatggtggtattgagcgggagaatgtggtcctgaatgagatctccctgtggtccggaagtaagcaagatacggacaatccttatgcgtattactctttggcgaatattcgtcgcctcttatttgagggacggaatgacgaggcacaggatttgatgtataaaactttcgtctgcaaagggaccgggagtaatctgggtgacggtgcgaacgctccgtatgggagttaccaattattcggaaatctagtgctgagatatatgtatccgaatgaatcggattctatcgctgagtatcgcaggcggttgaacctaagcgaggctatcgcttccgtctcttttaaaagggggaatgtgaattatcaacgggaaatgtttacctctttttccggggatctgggagtgattcatttggtagcggacgcagatcgggccttgaatttctcattgggtatgaatcgtccggaacatgcgacgatctctttggacggaaaggacttgctgatgcggggacaattgccggacggggtggatacgttggagatgaaagggatgcgtttcgcctctcgtgtccgtatcgtcttgccgaaggggggagatttgaccgcaacggatagtagtttatcggtgcgaagtgcctcggaagcgattatcttggtaagtttaggtacggattatttcgataaagacggtgtcggacaattcttggaaaaatacttatcgcaagcggaatctaaggatttctccaccttgcgccgggaacatacgctcgcttatcgctccctgtttgatcgggtctctttggatttgggaaaaggcgaaagggatcatcttccgatccatgagcgtttggccgctttcgctcaagataagaacgatccgggattggcggctttatatttccagttcggtcgatatttattgatttcctcgacccggcagggattactgcccccgaatttgcagggcttgtggtgtaatacgattcatacgccttggaacggggattatcacctaaatattaatttacagatgaatcattggccagcggaggtaacgaacctttccgagttgcaccttccgctaatcgaattgacgaaacagcaagtccctagcggcgaacgtacggccaaagctttttataacgcacgaggatgggtcacgcatattttaggtaatgtctgggagtttaccgccccgggcgaacatccgtcgtggggcgccacgaatacatccgccgcatggctatgcgagcatttgtacacgcattaccaatatacattggataaggcgtatttgagggatgtttatccgacgatgaaaggggctgccctattctttgtggatatgttggtgcaagatccccggactaaatatctggtgacggcacctactacctctccggaaaacgcttataaaatgccaaacggaagtgtcgtgagtatttgtgccggatcgatgatggataatcagatcttgcgggaattatttacgaataccattgaggctgctgggattttaggtgtggatagcgcgttcgctgctgagttggcggcgaaacgagatcgcttgatgcctacgacgatcggtaaagacggccgtattatggaatggctcgagccgtatgaggaggtagagcctacccatcgtcatgtctctcatttatatgggctttatcccgggaatgagatctcgatagagcatacgccggagttggcagaggcggctcgtaaatccttggaggtccgtggcgatcaaagcacgggctggtctatggcttggaagattaatttctgggcccgtttacaggatggtgatcatgcttataaattgctgggtgatttgttacgtccctgtgtagatgagcatacgaaggaggtgaagggaggaggttcttatcctaatttgttttgtgcccatcctcctttccagattgatggtaattttggaggaacagccggtattgcggagatgctgatacagagtcaatccggattgatcgagttcttgcccgctttgccatccgcttggaaaaatggaagctttagcggtttaaaagtccggaatggcggggaggtgtcggctaaatggacggaaggtctgttgacggaagctcgattgaaagcgatcgttcccggttctttcctgatcaagcttccggcgaattccgcgaacatgagcctcaaaaagaaccaaaagccggtttccctacctgtagtcgatggaaaagtaacagtggacttgttacaaggggaagagtttgtgttgcaattctaagttaccattctgaggggatgagacgcagcatgctgcgtctctacaacaaatgagaaaaatttaatataacggtaatctataaatgaaaccgatcgaaaggcgtgcggtgtcgtccaaagaggcatcgagcgccttcgctcgttcagataggttatattttttacctatggcagtcaagaagatatgtagattatcatcggccatcggatagaactctagtcctccttgatacccccatgccgtacggtattttcctttctcgtaagtatcgtaggctttatagatcgatgcgctttcatacattccttttgcgaatagttgccatttgggatgaaaacgatattgtatttctcccaccagcgaaagataatcgatgttttgcatacgaactggtggttccggttcctcttcctcttctccggcgacttcgggctgagtcaattcggtcaataatcctaacggatctaatttcccccgtgaatacatgacatcgaaataagcatagaccggtccggcctctatactttgaccggtaaagacgctatacatatattttccttgggcttgctctgcggcggatacggagtatcgtaaatgaatcaactcatccagaaagttaccgttccagttcaatgtgtaaaacaagggaactctcggtttcttaaatccttccggcagacgtccatactcatcttccatcgatcccatacgactgttcgtcacctgtaagcggatctcttgtgactcattcggctgataccccagcccgattcccgtaaggtagcaaagggagtattcattcatatcgctatactcataaataagcaaaggattctcgtcgtactcaaaaccaccgtagaacacatcttgttttccggcggttaaggtaaaacgctcattcagtttatagccaatatacgcatattcgatcgactcattcaaattctccaaggcttgtccctcataaccgccattcagcgtttggcgataccaatagaataaccgatcgttcacttctccggtaacatcaattttgacatccctgaaacgaaaggcggcttcatccagcttccccgagaaaaagtccgcgttgaatcctgcatgcatctccaagtccagattgaaaaccttgttgcgtttcggaatcttagttgcgtattcaaaaagagataccgaagaagaatcccgctctgggatcggagaatttgtctgagcgtaagacgttaacgcggaaccgataaataagaaggccgacagccaagccactgtgagtcgtttcatttactgatgttaattattaaagtggccgcaaagatacgaattattgctcggttttgcccatatgcttcatgactttagcgtccagatagaaaatgagttcttccgctatattcgtacaatgatctccgaaacgttccattttccggataacaccggccatatataaccctgccaacgcgctacctttatgctcctctatatatttggcgataatagcggtagaattatgattgatctcatcgatcaaattatccttcaagaagatacgggaagcgatctctgagctttctttctcaaaagcctctttggtgagtgagatcatgcttaataactccgacagcatttcttctacccgggtttccttgaccagttgcgggtcaatcggttccccctcgggaaggtttcctgcgaaacgggcgatgctttctgcgaaatctcccagacgctctaggtttgtattaatcttatacatcgccaatacgaaacgtaggtcgatcgctaccggtgcgtacaaggcgatgatatcctcgcaatcactgtcgatctttagctcgaaagcatttacccggcgttcccggctgattaccttataagcgagttccttatctccggtaagcatagcctcccctgcgttgtataattgctggtgaaccaatgcccacatctcactgatactattttttaaagaatgaatctcctgctctataaccttcatactcttctaattttcaatttttaattttcaattacccaaaccgtccggtaatgtaattctgtgtagactctttctccggattggtgaaaatcttccgggtattatcatattcaatcaattcccctaaatagaaatatccggtcttgtcgctaacacgagccgcttgttgcatattatgggtaacgattacgatcgtataatcatttttcagctcatgtatcaaatcctcgatcttactggttgaaatcgggtccaacgcggaagtcggctcgtccatcaacaagatagaaggcgagatcgccaaggcacgggcgatacataaacgttgctgttgtccgccggaaagagcgaatgccgattctttcagtttatcctttacctcgtcccaaaggacgacctgctttaaagtcttgaccaccgtctcctcaatataattctcatcgttgacaccgtttacccgcaggccataagcgacattctcataaatcgtcttaggaaaaggattcggtttctggaaaaccatccccacgtttttacgtaagcgatccactctctcgcttttcgtataaatatcccttccatcaatcaggatctgaccttccatgcgagtgtccggaatcaaatcattcatgcggttgaacaggcggaggaaagtagactttccgcaaccggacggtcctatgaaagcggtggacgtattcggctctatctccatggaaatgttcttcaatgcatggaaatccccataataaaagtctacgtttttagcatcaatctttatcataattgtcttatttttttaattcatttttaccttcttggcgaaataactacgtaaagcgttcgctaaaaggtttactaataatacgatgacgatcagcacgagcgccgtgccataagccatcccccgggaagcctcgatatctgtaccgcttgtagagataacatataagtggtaaggtaatgccatacattggtcgaaaatacttttcggcaattgcggcaagaaataagcggccaccgtaaaaaggataggagcggtctctccggacacacgcccgatcgaaagaatcaatcccgtaataatattggggaacgccatcggtagcacgaccctgcggatggtctgcaacttcgtagcccctaacgctaggctaccgtgacggaaagaatcatcgatacttttcaaagcctcttccgtcgtgcggatgataagtggcaaggacatcagcgccaaggtaaacgaacccgctataatagagtctccccatcccaaggtacttacgaatagagacataccaaataacccgaaaacaacggatgggacaccgcttaggttattcgtcatgatacggatgaaacggatgagtttcccgtttgtggcgtactcgttcatatagataccactcatgatgccgatgggaaaactaatcaagctacttccgatcactaaatagagtgtacctacgatagccggaaaaatccccccggaggtcatgccctcttggggtgcttgtgtcaggaaatcccaactgatcacgctcgctccctttaagataatgaatcccagtattacgaataagatcactacgaccaaataactcaggaaagaaaagaaaccgaaagcaacctgttgagaggcccgtttcctcttgtctatattccctaaatgttgaataggtgccatatctttaattaaattttacgtttggatgaaatatattctacggcgatgctcaaccccaaggtgatgaggaacaacacggctcccagcataaacaaggcttggtaatgcgctccacctgcgggagcctcacctaattccgctgctatcgtggcaggaattgtccgtaccggttcgaagaacgaggtagggataacggcggcgtttccggttaccatcaatacggccatcgtctcaccgatcgcacgtcctatacctaatacgacagcggacgtgataccggatatggagtaggggattattactttgtagatggtttgccattgcgtggctcccaatgccaagctggcctctttcatggctcgtggggtagttcgcatggcatcttccgctaccgtgatgatggtcggcaacgccatgatcgctaaaaccacgcttccggcgaaagcggtctcgcctaccggaaggtctaaggtcttttggataaggggaacgatcaccaccaatccgaagaaaccataaacgactgagggaatacctgccaataactcgataataggctttagcaaattacgggtttttgtattggcaatctctgccatatagatcgctaccgctactccgaaggggagggataaggcgatcgcacctatacttactaaaagtgtgcctagtaatagagggatcaagccaaagatcggagcgggagcggaggtaggataccatttcgtccctccaaagaactccgaaggtttgatcgtggctcccgatatgatttttcccgtaaagttctccgacttgtattgttccggaaagaatgcgataatccccggctctttatggataagttcattgattttctcgggaacatattgaaattcttcacctagctcttcttccgtataatagttggttaggtccgagaaacggaagacaagtatatcttgattttctccgtttaaatcttcccaattggtgatattggcatcgaagacatccatgatttgctcgggagacaaatgttcgactggattttcctgattcacagccaatatatatccttcctctacctccgggctgttaaaaagacctgcggcctctttaaataagaagacaatgatcaacaagatcgtaaagctactgacgcttccactgatcaagaatcctccttccactaatttttctataaactttctcacaatctttgcctatttattctgctgcaaagaaagagcctctatattaaggagagattaaacccgcttgaaagaattgtttcaaaattattacaaatgtattacgcattgtctgctatgagaatagggcatgagttcggttgaacccatgccctatgaattatgcctgtaatatgtttgtattacttattatacttgttccaatccacattgtgcatatcgccgctggccgctagttcctcatggaaagcgaaacagcatttcaggttttgaggcgtatgtcccttgatacccatagcgaggtattcttccaataacggtttgtaatccggatgaacacaattgtcgatgatgcaacgagcgcgttggatcggagatttaccgcgtaagtccgctacaccatattccgtgataatgatcttcacggagtgctcgctatgatccaagtgagataccatcggtacgaacgcgctgatcttaccctccttcgctgtagacggagtcgtgaagatcgataacatagccgaacgggtaaagtcgccggaaccaccgataccattcatcatacgagtaccggatacgtgcgtagagttaatattaccgaagatatcagcctccaaagccgtattgatagcaatcaagcctaaacggcgggcaacctccggattgttagagatctcttgcggacgaagcaatatcttatccttgaagaaatcgagatttgcgtagatctcacggattacctcattacttacggacaaagagcaaccgctggcgaatttaacgcgaccttgtttcatcaattcgataaccgcatcttgaataacctcagtatatacattgaatgcggggatagactcattagctcccatgcagcccaagactgcgttagccacgttacctacaccactctgcaatggaacgaattctttcggaagacggccggccttgatctcgctaaccaagaagtccgcaacgtttttaccgatcgccatcgtaacatcatccagcggagagaattttccaccttcattcggctcatcggttcttaccacaccaacgatcttagccgggtctacttttacacaatcgttaccgatcctgtcagaaggagtgtagatagggatctcacggcgtaaaggaggatcagccggctcgtaaatatcatgcataccgcggatttctttcgggtgacggcagttcaactcaacgatgatacggtctgccatacgacagatagtaggtaagataccaacacctgaagtcggaacgatctcaccatcctcagtaacatcggcagcctctacgattgcgacatcaatcttacccaagaatccgtaacgcaagctttgtgccaattcagacaagtgcaaatcgaaatattgtgcctgatgagcgtttaatgcggcacgtaagtctttgttagattggtacggtgtacggaatttgatggcgttagcgcgagccaactctccgtctagcttatcaccagtagaagcgccggtaaacataccgatttgaaaagggttacctttagcgtgttcttccgctgccttccgggcgatagctccgggaacgactttcgggcatcctgcgggtgtaaaaccactgaaaccgacattgtcattatgatgcacataagatgcggcttcttcagctgtaataaattttaatgccatgataattagtttttatgtttttaggtaaatacttactgttcaatatttcgggcgcaaacttacataaaattacgctgaatcgaatataagtgtggcgtaaattaatacttccggtttagaatctccgcacaaatgatcgctttcttcaattcctcgatgtctctgaaggtatcttctggcataagccccggttcttcctcgatagcactcatccttacggatggctgggtcgcgatatgattcgggatattcttctcggcggaaaggaatggagatgaggcaggcgatgaggttacgacttgcggtttctcaacctttgactttacctgcttttgtcggggagcgggcttaggtttttgcgtttccttttgcatatcctccaatatctcccagaagccttttccttctgtaggctggtcattaggcacaatttccctgtcgggttgccccaatatatcggggcgactcttcttctttttgtctttcgaactgaataagccactgacggcggcgataatcaggaaaacaatatataaccaatctcctacgttatccataaactttgattatttttgcacctccaaatgtaagaagaataattgagaagtgaaaagatgggagtatataaaacatcagataggtataaaagtaaataagggtaacttcacagccacccttattcgatttaaccaaaaccttaactatgaaaaaatttacgtttttcgaatgcaaatataacggtgggattcgaactatgcaagcgtttgcgtaattatttttaagaatcttgcttatttaaattatattaacatatagtatggtaaatcaagaaaacggtgtggacttaaaatccgctacccaaagcgatgaacgaaagttgtttatcgagacctacggctgtcagatgaatgtggcggacagcgaagttgtagcttctatcatgaagatggatggctatagtatgacggagaatatcgaggaggcggatgccatcttcgtgaatacttgctccgtacgcgacaacgccgaacagaaaatctatgggcggctacagtatttccagtctttaaaacggaaaaagaagtccttaattgtcggtgtattgggatgtatggccgaacgagtgaaggaagatctgatccatgtgcatcatgccgacttggtggtaggaccggattcttatctggacttgccgaacttggtgggagcggtagagcacggagagaaagcgatcaacgtggagctttctacccaagagacctataaggatgttattcctttgaagttaccgggcgtacatatctccggtttcgtgtctattatgcgcggttgtaataatttttgtacgtattgcatcgtaccttatacaagaggacgcgagcgtagccgggatatcgagagtatcttgaatgagatacgggatatgcacgagaaaggctttaaggaagttacgttgttgggacaaaatgtaaactcctattctttcgagaaagaaggtgagaccataaccttcccgatcttgttggatcgtgtggcgaaagaggttcccgatatgcgaattcgttttacgacctcccatccgaaggacatgagcgatgataccttgcgtgtgattgccgcgaacgacaatatctgtaagtttatccatctacctgcccaatccggcagcagtcgcatcttgaaggtcatgaatcgtaaatatacccgtgaatggtatctggaccgtatagcggcgatccgtcgtatcgtaccggattgcgctatctcgactgatttattctgcggtttccattccgagaccgaggaggattatcaagagactttatccttgatgcgtgaagtgggatatgatagtgctttcttatttaaatattccgaacgtccgggtacatatgccgctagccatttggaggataatgtaccggaagaagagaaggtacgtcgtttgcaaggtatgatcgatttgcaaaataagttgtccgaggaaagtaacttgcgggatataggcaagactttcgaggttctgatagaaggattctcgaaacgttcccgtgagcaattgttcggacgaaccagccaaaacaaggtggttatctttgacaagaagaactatcatgtaggtcaattcataaaagtcaagatccataaggcttcctcggcaaccctgttcggggaacctgtggaggaataagaaaaagaaaacgccaatacgttccatttcgagcgatattggcgtttctcttattatcttctatctttggaatatctccgggtatttgttgatgaaataaaccggcgtgcaactccatgcgtggcaataactattgatcgggaaaaatccgtaaggtgataattcgtcattgttcggatcatatacctcccagaatgtatcggctcctttattcaccatgccgccccaataactggttaagagcgaacgggcctcttgccgcattccacatttcaacaaggcttccattacataatgataagcgtacggacatcccggatagcatgcgtcgggcatcgataggacggtggccatcgcttttgctccttccttggcggtaagcgtctccgataggatcatccacacttgtgataggtaagacacctgacggttagggccgcttacgatcaccccgttcttttggtcatagaatgttttccgggcggctttctttatctggccggcgatacgaggccagtctccagcctccttctcttttcccagcattttagccagctcatagcttttctctaatgagaatgccgtaagtccctgcatggatgcttggcgatcataattatctttccagtcgaataccaaccaataaatcggcttcttttgcatatcgtagatccaatcgtccgagtattgacgcaaggccatctctatttggcggaccactaccggccataagtccaaggcgacctccttgtctccggtctctttcaggtattccagcaacgctacgttatacagcagggaatagtccaagcaatgcgtaccgttttgcggatgaggggtcggtgtctccaatacggtggcgtgcagcagtccttcatcattggctagagccgctaataaatagaggcaacgtttcgtcaagtcgtggtttttatacgaccatgcgttcgctagcgcctccagatacaagtctccgatccataaccggcgatcccgtttcgggccatcctcatagacggtctgcatacattcttttaatgtaagcaatcctacctcattgattttacggatcaagggatcggtcgtggaagccagtggcaatggagccgtcttagccgatgtctgcgcacggaacgttagcttgtcgaaggcgaaatcgaaactggaagcgcctagcaactctatcttgagataccgaaaagacacccttctggggatggaggcctcgatgggtacggtcattaacgtcatcacctcatcttgtagccaagcccttgacagaccgcccggataagggtcgaaaggcgtgttcaattccgagggaacttcggcgaacgtgaatttgatacgtaccggagcgtccgaaacctgttggctaaggagcttgagcgagaaatccaaataccccgtcagatgctcaccgaagtcaactataaccgatggatgtttcttcagggactcattgaataacagatccgtgcttccttcgtcccgcatgcgccaaccttggtaggctgacgcatctttgatggaagtgacccgtttgaccggcttatgttccgtataggttaacactggcttgcaggcctcactcttttgaagccatgaagcgctttctttgaaataacgactttgtgctgatagggtgaatacaccgacacagcatagtaaacttagcaggattttcatatgtgctcttttcatgatgcgaatataagaataacttcgttaatatccgggattttgtttaagctcgctgttcaagtcgatttctcgcagaggtatgggcaacaagcatttatctgggttgaacagataagcgttcgccacgggttgaacaccgtcgggccaataataagattcgggatttgcctttatcttttgtccatgtcgtgtcatgacttccacggctcgtcccgttctcagaaggtctgtccagcgtttgttctcgaatgccagctcgatccgtctctcttggtagatagcctctctcaacgcatctacattctgggatttgacaggagctaatcccgcccttccccggatacttgcttgcccgaaggtgtcattcagataatggatagcctcgtccggcctattctgctcgttgatagcttccgccagaaagagcaatacctccgcgtacctgtagaccggccagttgtcatccgtgtaatagggctttatatgctcatgaaaatattttttgataaaaggataagcggttattcccggagctggctcatagtcaactatacttttcacgccggtagcgtcgagggcgtagctatcggtgagcttaccttccaccataccgatggatgcgtccaaccgtttgtctcccttttcgtatgcgttgattagatcgatcgtaggggtgttaaacccaccatggtctacgttggaaggacaaggattaggggttgttcccgtgatggcagacggattcgtcatatagggcaagaatctgtatatgaaatcactttgttgttctaatgaggcgtcttgcatgtattggatctcgaagatagattccttatggttcttgttcgagatggaatagatggagccgtaatccgctaataactcatactcgcctgaggataccacctctttcagcgtttgttctgcttccgcccatcgttttagtaccatgtatacgtttcccaataaggtctgtgcggagcctttggaaactcttcctacctcttgccttgattttacaggtaggagatcactggcttcttgtgcgtctttcatgatttgctcatatacttcgtctacgctcgcacggggtttaaatgcctcctcatacacggtagagggtgtcgtatgcagaggtacgccgccaaagtattgtactaggttgaaatagcagaatgcccgaaggaacaaagcttgtcctttgaggttgctttttgcttctgcgtcaaaatccgcttggtctatttctgagataatccggttacatcgtccgatgattacgtagcagttattatacttcgtaccgacattaccattggtggatgtctcaaggaactgatccggatcttctccgtctaaggatgatttggcgatatggatgatatacgtcgtattatccgatttggcctctcccagattccactcttccgtgttgtacatgttctgtaaaggttcgtaagctccatttacggcttgcctgaaatcctcctcgttctggtagaagttctcggcggtgatctcgctatacggcgtaagattcaagaaatcactacaggaggcacaactacatcctaaagcgatgcttatggctatattgaatatcgttttcatatatttcgtataattagatagttagaagttaacatttaaacccagcgtaatggtccgtggaacgggataggtggtataatcgaatccttgttgcaagctattcgccgttgttcccgtattgctgatattcacctcgggattagcgccgatgtagctagtgaacgtatatacgttctggaaactgacgtaagctcgtaatcctttaatgatatcccggtttcttaacggaacttggtagcctaaggtgatattcttgattgtcaagtagtttccgttataaaggaaacgggaactgaaccagtcacgttctggtgccgtggtacccatcttggtcgttccataacggccgttacccggattctccggtgatttccagcgattgtctaccgctttatacacgttgaacacaccatccagatttccagcgaactgatctaccatattggctaactcaaaaccaaaaccgccggatacgacaattgacaaatcgaaattcttgtaggtgaacgagtttgtcatgcctactatccataaagggaccggattgccgatgatatcgcggtcatccccttgggcaactttgccatccccgttcacatccttgaagcgaatggttccgacatcggcttgtgcgtgtttcgggtatttgtcgaattcttccttgttcttgtagaccccttcccatactaagccgtaaaactgtccgatccgttccccgacttgcgtgatgttgttaccgatgatcggggcgtcatctacacccagttgcaagcatttattgtcattgtaagatatgttcaggtcggtagtccattgtaatttgcctgtcaggttcttggaggatacgcttaattcatgtccccagaacttcagtttgcctgcgttcgactggatgttgtagaagccggaagagatcggtacctctagcgagaacagcagggcgtccgttcgcttgctatagtaatcgtacatgatggataagcgattattgaagaaaccgacatccagaccgacatcgacttgcttattcctttcccagcccagattcgggtttcccattcccgagatgcttctgccgctggccaaggcgttattgaagttgctgttcgtggtggtgatcgtcgccaaatgcgtatagttaccgatctggtcgtttcccacgataccgtaactgatacgggccttgaggaaagagatcgttttctccaatggtttcatgaactcctcgtccgagagtatccagcccgccgatacggatggaaaattaccccaacgattgttcttaccgaaacgggaggaacaatccctacgcatcgctgcgcttaaaaggtactttcctttgtaattatagtttatacggccgatataggataaaagggaccattcgtttatgtttccatccgccgtgatggtaggggcggcattgaatgtcgatattttatcgtcgggaaagttcgttccggtcaccatcgtatattcgctatggtatttttgtgcggatatgccgaacaggagatcaaaggaatgatcttttatctgcttgctgtaggtggcggtattctcccacagccaagtgtagaatagattattggattccttcgcctcggggatctgatagggagccttatagatctctccggaggtggagggcttgaacgagttccatttattctgtgtcaagtccgcgttgatgctggtctttacttttaaatctttgaccggctctacctccaagaaggcgtttgcgatcagatgggtgttctgggtcttgttcttgttgaggctaaccacattataccagttcgggttatcgaacaatcccggcccactggccacaagcggaatactgccatcctcattcttatagggtgcgagaggtgttgtcaacatagctccttgcaggatggaacctttatcttccgtccagttaccgtccgattgcgggctattattgatggagaagctaggcgctaggttcacgcctaccttgacgatcttcgagaatacgtattccgtattggctcgtgcggagaaccgttggtaattagagtttgtcaacactccgtcttggttgaaatagctggctacggtggatgatttaaacttcccgtctccgttgctgtacgacaaactgtaattctggatagcggcgggacggaataatacgtcataccaatccgtgcctttacccagcgcttcgggatgctggtaagcgggatcgaccgccaatccgttctcttcagcgatctctttcctgaaccgtgcgtattcggaggcatccatcatatccggcctccctttctcgggtacgtattgtatgcctccatatacgtcgacgcttagttttttccctgattgggcagtctttgtctgtatcaatacgactccattggcagcccgggaaccgtaaagtgatgtggcagaagcgtcttttagcacactgatactttctatctcgtctggattgatcgtgctgatatcgcccacgataggcattccatccactacataaaggggcgtggttcctccggacagtgacgcttgtcccctgattcgcatggtcattccttgtccgggtttaccggatacttgattgatttggacaccggcgaacttgccttgcatcttttgcgagatctgggctacgggcatatccgccatctcttccgacttgatggattgcacggagccggttaccgcccgcttgatctgtgttccgtacccgactactaccacttcatcgagcttctgcgtgtcttcccgcagctgtaccttgatatgattctctcctgcgccgaccataacgtccttgctgttatagccgataaaagatacttgcagggtttcaccatccgataattcgatcgagaatttaccatctagatccgtgattgtcccattattggtacctttcaccactacgttcgccccgatgatagactctccgttggcgtcaagcacgacacctgtcacttttcttgttctctgttgagttacggaatcatcgttccgctccgtatacgggttctcttgtgatggatttgtagcgatagccaatgccggcgatacgcagaggaagagcaaagacaatgatcccatcgccacattccaagttctcattttacttttcatacttttcatttgttcataattgaatagataatgttaactacatacgataagtctgatagattcagattaactaatacattattagatatactccataggctatatgttataaagttattaagtaccgtaggaactcaatgggtaatttatgtataggatattagaggagagtggtttaggattgattgcggatctgttatgtcatttatctaacaagaaatgtcatttttgtaaccatttgattcttattacttcccatctttgccatatcgaaagagagagatagtaaggatttagttcctacggaactgtggttttttcttgcgtattattttatagtacacgtacgtaaattatgtttatagcttcccttttcataatagcgacagcttaccttgatttttattagccgttcttttgggttcttaatgcattgtactgatatttttctggagtggtaccttgagtatgaaatgaaaaaactaaatcatctaccatatctgccattatctatataagtatctaattataagaaatttgttgaatggtggtagataataaacatctaccactatcagcttgcatctaccactatttactgcttttcaaccactaaatgcagccgttcactattcgctaaccacattactcgttctgcgagggtatgccaacaggttgcctgcttggttatttgtataccttgtgtacggatttaatgtattgaataataggtatttatggttttttaggcataaaacaaaagttttcatagcggaaaacttttgatttgtgcttacgaaactttagttttccctagaagaaactttagttttctctaggagaaactctttgttcccctaagggaaatgtctttcaaaaataacacgttttcttatccaatgcaaagaaaaagtatcaatgtcaagtataagtggtagatgttgaatgataattgtagatgtcaggctatctacaacctatatgtaatgctttgatttataaagcatacatggcgtagtggtagatattgtagatgttttcataaaatcaatattgtagaattccttttatctcaattatgtatagttgcagtctgatatttggttagttatgctattccacatgctttaagaagagaatcttatagcttgtgatgatataaagtttttatggtagaaaattttgtttacgtaaaaatatttgatctataagtattctgtaatagataaaaacgcctagtctaaacgatcgtttattctaggcgttaaagataggctatatttttgaataaaacaaaatccagagaaacttttaaaaattgattatcaacgcataaacgtaaatatggacgcttatgcgttgaattcaataaaacgccagaataaaatgatcgtttagactagtcgttttataaccgatgatttcgcataactgcttgtaaatgatgattatgagaagactgatatgcaggaaactacagagtttatgaatatagggtaaatgttttaaataattgaatattactaacttataaaaattaatcgtatgaaaagaagactactttttttgttcgccgtctttatggtgggtgcaagtgtggggtggggacaaatgatccctacatactacaaagtggctgtaggaacaggtggtgatggatcatctgctggttcacccatttacaaggcaaacttggaagcagcattgtctgatgcggcattatcttcattagatagtgtgatcatattgttacctgaaggggaatactcggctaatgcagctccttattctatcaccaaatcatcattggctatcattggtgaaggtgatacctcaacagttacaattaagtctccggtagatattgagctaacaaacggagggaatgtgtctttccaaaaggtacatctaacagcaaaaacatcgactggacgaggagttgtcgatattaaatcctctaaaacgacagtgtctttcagtgagagtaagataacgatagaggggcggggaacgggtgatagtggttccggggcttgtttcggtatagtgtctcaattaactgtaaatgagaataccgtaaactttatcaactcccgtatgtatatgtctgagggttttgaaagaggacttgcatttcgtgatggtggaggccatacactcaattttataggaagtaagatggaggggccttcagctaaaggtttatatccttacgtgatcggcatttgctcatgggtgggaggaactgataatactaatccggtaacttataatataaggaattctgtagtagatgtgaattattatgcaatatttgccatcaaccaagcggggtacacaaatgccgtaaatataactatcgacaattccagtgtaactgcttgggccgcactttttctaagaggtgatttagtaaatgaagcctacccgcataatgtagcgatctctaatactcatttgtatggacgttcttaccaaaatgggccaagtgatggatttggaactgtcgttttggataattgtcaaaatttgactatgacgatggactctaaaagttctatcgtttcagagaataaagcaccgatagatagccccatcacctatatgtgtgtggctgatgtccgtaagaatacttccggtacttggacgtttacatccaccgatggctctaaggctttaatccaatccaagaatgacaaatatgctcctacattattttttgatgatgcaggaacatatttggaggttttaggggttgaaaatgttgagtttaagactgaaaacgagaagccttgcattgtctcgattcataagaacgggactttgaacaatgcggcatccagtttagacgtattattgacgaatatgattttagaagaggaggataaagtgattttcccggaaggagaatatactttaccaatgacgctgcctctggataaatcaatcacgcttcatggagctgggcaaagtcagacaattgtaaatgggcatatttccgttaattcaccatcaggaggctcagttgcattgaccgtaagcgatatgaccttaaaaggaactgataattcctctgcgcatgggcttattggtatgattggaacgggcaaggatatcgtaaagttaaccaattgtaagttagatggtggtgcggttaccgctcaaaccgctgccgtaggtgtccgtatggaatcagtgggagcggagttaagcttgacgaatacggatatcgatgtcaattattatggaataggcttacggaataaagagcaagtcttagatattacgggaggaacctttaccgcatggggggcgatcatgacatcagccggaagtatgagtccaagtgatggtacattagctaatacgaatacccggataacggcgaaagacgcgacattcatcagtaggactcttctgaatgggaaaagcaatagttatggagctgttattcttcaggaaaaatacaacggagttacagctgatttcacgaattgcgagttgcgagcggtagatggattagatcctttgataaatgctacccaagctacggctacggatatacgttcgtatggaaatacgatcacatttacaggttgtacgttgtcttctttggaaggaacgaataatctcccggatggaagtaacggatatttacatgccggagttattcggctaggttggagtggaacggatgataagtcggaatttgcggataatacgataacgatcaacaattctacattgaatggcaaggagggagagaactgggtctattcacatcgcgaaaaggaggcgaaaaaatacgacaagctgacgatcaatggaactgtttatgatccggcctcgggtcttatttgttatggagagccagatattcagaataagattgataatgcggtagcgggagagacgatttctgttccggcgggagaacatgcgggtttcaatgtcactaccgctgatgtccggataaagggagtttatggaaaaacgattattaaaggaacgaagaagtatacgggttcttccatagcttgtatctctgcggataaggtgactttgatgaatctttctttcaagagttcaacggatggctcgaatcgtccaacagcattgtttgtcggtggaggtacggtggagattgatagttgtatttttgaggataagctactccaaacaggtttatattcggaaccgggtagtactcttaaagatgcgaccttgttggttcataacagtacttttaatgtatatgataagaatttgttgatctcagcgggacgacttaacgctatggtcaagaataatgtttttacggatagtgatatttcggtagcgaagaatgacggctcgaatgtcgttgaatcaaatgagtttcataattgtgtcgtgaaagttgaggatggtgtaacattccaatataataagatgtacccgggcgaccagacatatgtatattccattcgtcccaataatttagagggaacggttgttgcgccgaataattattggggaagtgataatccggatttttctgccttgattgataaaagcagggcaccgaacggatctgtagattatttcccctattattcggatgtcgctttgggtaccttaatctataagatggtaacgatttcggaagatacggtctgggccactccgcatccaaatcaaaaggtcaccgtcttggatggcgcgactttgacgttgtctgttccaatgtctttagataccgttaccatgagagaaggtgcgcaaataaagtcaaatcttgcggatcaaacaggaagcgtgaccactaagtctcttcgtttctctccggatctctccggtactgagtggaaggcgttaggagtgccattagcctctgccgtgatcaagaactctacggaggaggagatctcggctccaagtgttcaaaatgttgataatggtatctggttcgctaggctgaaggataacaagactccggagttcgtggtggatgagagtgcttttggcatggctggtctttgggcggctaatggcgatacctatacgatctcttctgaaggagcttttgaattcaagaccttggaagaacctgccgctccaactgaaacaggtactttcttgatgtgctcgaatccgaatacatttacgattaccttgaaacaatctgcttatatattgacaacggatggaacctctttcgagcaagaggcaaatccggagatcaagcctttccaaagctttgtcttgacagacgccaagacattgagtacgcttcgctctttacgtatcggcgatggcgtggttacgggcaaccagacgatcgagccggtagatggttattacgtgactaccgatcgtggcgctatcgtgattcacacgccggagcctatggacgtggtggttatcagaatgaatggcaaggtcgcttatcgtggcgaggttacggacggacagcggatcatggttccttcgggcatctatgccgtgaacggtcaattagtaagggttaaataacgattaaaacaaagataaacatgaaaaagagtatattagcgatattccttgctgtcattgcgatggcacaggtacatgcgcaagattcagatttacgttccgccccggatcttccgacgttcaaggtgacattgaattatagctcggcgaatacggatcaaggaaccataatcagtacggtagccacaggttccaaggtggcatataatagtaaacccgttttcacgatcacggcgaagcccggatatgtcctgtcggatataacgatgaatacggctactattggcacgttaccgagcggtacttttcaaaatgataatacgaccacctattcctatacttccaccgctttgaccggtagtacggaaatcaaggcggtgttcaaggcaaaagagcaggtgacagtcacgatctctcctgagtatgccaccttggatgagataagggcgaaggtgaatttgcccaaggttacttttgacccggttattacggggtataaagtacaatacagggaggatggctctgctgctttgacggatgagttacccgaaaaggctggactttattatgttgtcgtaaccaagtcggagactgatacgcaagccgccataaacaaggagattctattcaaggtacaaccgccccatacgctttcttactcgtttgaggaggcgcaaggatctgtaaccgcttctatggatggctccattatcgccagtggtgatgagatcgtttataataagccagccgtattgaagattgcctccaagcccggttatgtgttgagtagacttaccgtagataataatgaggtgactttgccgaaaggaacttttaattcttctacgaatgagacttcctacgcggattatacgacatcggcgttgaccgcttctacggttattgacgtgcgatttgccgcgaagaaaaccgtatctgtaacagccaatccattatctgccacgaaggatgaggttttggctggtaagaatcttccggttattacattttcccccaatacgatagcggggcagaaggttcaatataagaacgcttccggagctttatccgataaacttcctgcggcggatggtgtttacacggtcgtcgcgaccagtcccgagaccgcggaatatgccgccttgaaggatgagaacatgaagttcacggtatctaaagcgaatgtattaaattataacgtggaaacggccggacaaggtacggttaccgccaagatgggctctacggacatggcaagcggtagcgagatcattaacgggcaacctgccgtatttacaattatcgctaaccccggatttctattgaataagattgttgtgaatggaaccgcggtatcagccttgccaaaaggtgcgcttaataaggataacaccatctcttatacctatacgaccgcctcgttaaccgcctctacgaccttatcggtaggtttcgccgcaaagaaaacgattgctgtgaatgtaacaggttcttcggcgacaaaagatgagatcgtggccgggaagaatttgccggttattaagtttacgccggaaatagcgggacaagcggttcgatatcgtgcggccgatggttcggagacttccacgttaccgcagatagtcggagcttataagatcgtcttatttagtccggagatcatggagtatgccgcgttagaggattcctctaaaacgtttacgatccgtaatgccaataccttggcttacgctgtcgatggtggacagggcacggttaccgccaagatggataacaaggacatcatgagcggtggtgagatcgcttacggtaagcccgtcattttctcgatcgtatcgaatgccaactataggctaggggctattaagcaagcctcttcggatgtggatatctcgaagatcaagggaacgtatgctaatggaaatacctcttacacgtacacgactcctaatctgatgagtggcgatagctatacttttgcgttcgtctccaaggatacggtgaggttcgtggctaacaaccttgtccagacggtcggctccatcaagccggtcacggtaacaagtgctgtggaggatatcaagatcgaatatcaattgagcggtaaggcttgggttacgacattgccttccacgctggccgtgggttcttataaggcccgtttgagccgtgcggaggacttgacataccgtagcctctctgatacggttacgttagtggtggagagcaagaaagaggtggagagtttggtgttacctactccgggtcgtattgaggaaggacaggctttatcggcgtgtaccttgatcgatggaacttcttccggatcatttatctggaaaactccgaacgagatcgcttctctggataagaaaaagtacgacttgatattcgaaccgaatgatcctgttctctatgcggctaaagatacgtttataaccttgaacgtaattcctgtttattctatgaatgttaccgccggtaatttcggtactgtcatcttggaggggcgtaccgcaaatgataaatacgcgagaggctcggttttgaaagcgacagccgttgcggataagaattaccggtttgccggttggagtgatgggaatacatcggctacacgggagttgcaagcgaatacgaacttggatatcgtagcccgtttcgattcgatcgtttatggcgtgacgtttacgaatccgatgaatggttccttgaaggtcttcgcgaatggcgtggaggtaaagaatggtgctgagtttttgcagggaaccttattgactatcacggcgactccggatccgggctatatggttcagtccgtgaaggtgaacggggctttggtgaataacggttcttatactttgatacaagccgctgatatatcggccgatttccttcaaaaagaaccggataaacatttggtaaaggttggggagttgaagaatggtagcgtgaatctgatcgaggtggatacgaaggcacccgttactcccggtgaggctatctctgaaggtgtgaaagtgaaggtgataggaaatgcggattatggctatgagctggcatccgtgaaagtggaaggcgcgaattataatgaggctgatggctcatttatggttgggaccggagatgttacggtgaacgcgagtttccaattggtgaaatatcaaataacctcggcgttgaatatccccaatgcgggtaaagtcgtattgaaagataaggccggtaaagaggtggcttccggttcaaaggtaccttatatgactcaactgaccgcttctgttgagacggaaacgggatatcgttttatgaatatgatggtgaactcttccgagatcaaggatggagacgtattcaccgtttctggccctatggttgttaccgctaattatgtggagaagaaagatttggcttcgctgattgataagacgacgcaaacggtagtctataataagcaataccggaatttcgaggttaagattacgggctattccggtttggactttaaggtcgcatattcccggagtggggtagaaatgacagagaatcctaaatcggccggaacttataaagttcggattacccgtggcgaggatgatttatttaaagccgtggatgtaactgccgagctgattatcaagaaggctggtatggcattgctgaaagaaccgactatagaaggggaggattattcaaagattgacgctaaacttactcaagacttcgaggatgtggaatggaatccttctacacaaaaatcggcgcttcgtgcgaacgtgactggaagcccgacaaaggatcaggtaaatattctgcgctttaccccacttgacaagagtaattatgaatcggtagattattcaatgccggttggtgaagtaaaaacgttttctttaagtgcctcaaatacggaggttacgaatggaggcttggttattagcgattattctaaaattccggagaatacggttataaagttacgggcggtagctcctagcgagaatcagcgttttgattcttggggtgaaaatgtctcaagcaccgatagaaagaacccagagataacggttactttggcggctgatgcgacatacaccccgaattttgtggataaacctaaaataacggcgaatccttcagatttggagtttgtttataatggttccgtaaggcttgtggaattgaaagacattttgagcggtagttatccgacagatgtaaatattaaatattcaaatacggatggatcggttgctaccccattgaacgcaggtacttatcttgtgactgtaacacgtaccggggacgagaactggcgatctttcgaggcaaccaagaaattagtgataaagaaagcgaaggtcgtagaggtagtagctcctaccgcatctacgatcacggaaggtcagtccttgtcggaattcctattatccggtggtgttgcgaaaggtgccgatggaactaccatatccggtaaatttgaatgggctgatgcgtcagctatattgaaacccggcgatagccagaaaaaggaagtgatcttcacgtcgtatgatccgaattatgaggatgcgactacgaatgcggaggttacggtgaaaagttcggatgcgttagttgtcacgttcgctcaaccggaaaatggttctttgaaagtctatatgttgaaaggtgagggcgagaagaccgagataacgagtggaaccgctgtggcgaaagcgactaagctaaccattgagacagaagccaatccggattatgaattggccgttattcaaataggcgaagagaagtatacgacttcgcctgtagagattgaagtcgataagtccttggctattatagcagagttcaagccggtttctacacctccgggaacagatgtggctgttacgggagtttctttgaatatcacgtccaaggcattggccgtaggtgaatcttttgccttgcaagcgaaagttacccctaataacgccactatgaaaaccgtctcttggagtagcagcgacgagacggtggctactgttgacgcggatggtgtcgttaccgcattgaagatcggtacttgcaagattaccgtggctaccgatgatggaaacaagacggcgtcttgtgtggtaactgtctccggtacggtaggtatcgagcaaatcatcgacgatcatcaaatctattgcgagcgaggtgcgataaccgttcatccggcctgtccaatctcgatccgtatcatagcggtgactggagttagcctgtatggcgactcaattatcggacctacccgcatcccggtatcgacaggaatctatctgatagagatcaacgagaatggcaagcatataacagtgaaagtaaacgttcgctaacaaccttattttaagaaactaacccttgagtctttaatgttggggaaggccgctaggaatactcagttccggcggtcttcttttttatcattgtatatgtacgaatagcctttgttagagttgtagaggttaaatattctaaaaccctttcggcttacttattttattcgttcttttgcaagaaaattgggaggtgtgttctctgtacgcatctccttaatttatttaacgttaataagtgagagtctgatggctgaaaataaaaaagttagttctgtttctttctttaactcccggcttacgtctgttattagtatctccttggtactattcttgctaggactcattctattgatagggatgttgggtaataaactctccgtttatgtgaaagagaacttatctttctccatcgtgctgaaagataaccaaaaagaaactgagataaagaaaatgcagaagagcttggatgctcttccttttataaaatcaaccgagtatatatcgaaagagcaagccgcgaaagagttggaggaagaactgggcgagaatccggaaatcttcttaggctttaaccctttacaggcctcgattgaggtgaaactgcattcggagtacgccaaccccgatagcctccaagtgatagagaagaagattagaaactatacgtcggtctcggagctgctttaccgaaaggatatgatggagatagtccataataatatgaagcggttgggcttgatcctgcttaccttggcggcggtactgatgattatctcgttcgtgttgatcagtaatacgattcgcctgttgatttattccaaacgattcttgattcatacgatgaagctagtgggggctacttccggctttatacgtaggccttttgtgaaatataacatagtaagtggcattttcgcctctatcttggcaatattgatgctaaccggagcgttatattatttgcaaaatgaattgaaaggttttatccagatattggatatgcaaacattattattggtttatgtggcagtgtttgctttaggtattgtcttgtccgtgatcgcgaccatttttgccgtgaataaatatttgcggatgggggtcgataagttgtattatatttaatgtacgaataataaagagttgagaaagatggctaaaagagattttgctttcggaaaagagaattttatactgattgcggtagcggttgcctgcatcgtgcttggtttcatattgatgagtggtggaggttccggggataatacgttcaatcccgatatattcagcgcccgccgtatcgtggtagctccggtggttacggttatcggtttcgtgatgatgatttttggaatcttgaagaatagcaaagataaagaagtaacagaatgagttggtttgaggccttgatactgggtatcgtacagggattgaccgaatatctgccggtgagcagtagcggtcatttagcgattggctcagctttgtttggtatagagggagaggagaatcttgcgtttacgatcgtcgtgcatgtggcgaccgtattcagtacgttagtggttttatggaaggaaatcgattggatattccgtggtttatttaaatttcagatgaacgcagagacgaagtatgtgatcaatatcttgatttccatgattccgatcgggatcgttggggtattctttaaagatacggtagaacaaatctttggatcgggtttattggtcgttggttgtatgctgctattgacggcggctttgctggcattttcgtattatgccaaaccacgccagaaagagtcgatctcgatgaaagacgcttttattatcggtctggctcaggcttgcgccgtgatgccgggtttgtctcgttccggatcaacgatcgctaccggtttgttattgggaaataataaggcgaaactggcccagttctctttcttgatggtaattcctccgatcttaggagaggcgttgctggatgtgatgaagatggtgaaaggtgaagatgtggctggggacattcctgcgttatcattagcggtaggtttcatggccgcttttgtttccggttgcgtggcctgtaaatggatgatcaacatcgtgaaaaaggggaaactgatttatttcgctatctattgtgcgattgcgggattggtgacaattgcttgtacattacttaaataaagaatggattttatagctggagagattttatattttaataaaccgctaacgtggacttcttttgacctagttaacaaatttcgctataagctaagtcggaaactgaaggtaaagaagattaaagttggacatgcggggacactggatcccttggctacaggtgtgatgatcgtttgtaccggaagggctacgaagcgaatcgatgagtttcaataccagacgaaggagtatatcgctacgttgaagttgggagagactaccccgtctttcgatttggagaaagagatagacgccgtgtatcccacggaacatataacccgtgagctcgtggaggaggttttaaagacattcgtgggtacgatccaacagattcccccggtgttctccgcttgcaaggtggaaggtaagcgtgcttatgagctagctcggaaaggggaggaggttgaactaaaatccaagacattggttatagacgaactggagttgctggagtgtgatttgcctgttataaagatacgggtggtatgtagcaaaggtacctatattcgtgcgttggctcgtgatatcgggaaggccttggattccggcgctcatttgattggcttggaacggactcgcatcggagaggtaaccttggatatgtgtatgtctccggaggagatcgatgatttcttagagcagaatgtggtaaaaatagaagaagaaaaataaatagagtgcattatgaagctttcgaaattcaaatttaacttaccgtcggaattaatcgctttacatccggcgaagaacagagatgagtcgaggttgatggtcgttcatcgtgatacgggtgagatcgagcaccgcgaattcaaggatattctagactattatggaaaaggtgacgtgtttatctttaataacacgaaagttttccccgctcgcttgtacggtaacaaggagaaaacaggggcgcgtatcgaggtgttcttgttgcgcgagctgaacgaggacttacgtttgtgggacgtattggtggatccggctcgtaagatccgtatcggtaataagttatactttggcgaggatgattccatggtcgcggaggtaattgataatacgacttcgcgtggtcgtacgctccgtttcttatatgacgggaaccacgacgagtttaagaaggctttgtatgccttgggcgagactccgctgcctaagtatatcgaacgtgaggtggaaccggaagacgaggatcgttatcagaatattttcgccgcggaagaaggtgcggttgtggctcctgctgcgggattgcattttagccgtgagttgatgaaacgtttggagatcaaggattgccagttcgctttcttgacattgcattcgggcttgggtaatttccgtgagatcgacgtggaagatttgacaaagcataaaatggattctgagcaaatggtcgtaaatgccgatgtagtggatatcgtgaacaagggaaaggatgaggggcacaaggtttgtgcggtcggaacttccgtgatgcgtgcgatcgagacggccgtaagtacggatggtcatctgaaagagttcgagggctggacgaataagtttatcttccctccgtatgatttcagcgtggctaccagcatggtgacaaatttccacatgccgttgtctacattattgatgatgacagcttctttcggtggttatgagttgatcatggacgcttacgatatcgctttgaaagagaaatatcgtttcggtgcttacggcgacgctatgctaatcctttaatccggtttctatggcgacagcttaccttggattaggtacgaacgtaggtaataaacgaggaaatttggtgacagcggcggcgctgttggctgaaagggtgggagatgttcttgccctttctgatatgtatgagacggagccttggggatttgaatcggacaacactttcttgaacgccgtgatcgttatgacgacggaactttcccctatggaattattagacgctacccgtttgatcgagatcgagatgggacgtatcgaaaaaagtgacggtgcgtatcatgaccgtatcatcgatatcgatctgttaatggtggatgagcaaatcctgcatacggagcggctgacgctaccgcaccctctgatgcacaaacggtcgtttgttatggaaccgttggcagaagtagctccgttggtgaaacatcctgtgtttggcaagacgatgcgtgaacttttatccgaattataagttttaattatgaactacgagatttgagttatgaataaagaaattaataaagcgatgacgcaagggatcgtcttcaagaaagcgaaaggcgaagcggaagattcgaatggtaagaaaatcaagttctctgatttcttgaaagggacacatggctctgattcagcgaaatggaaggccggttttaaatataaaaaagccttacgtaattccaaaaagaagaaataattttcaattttcaactttcaattctcaattattgcgtatctttgcgaatgaattgacgtggatagatttgtattgcttgcaaccacgggaaaaaatgctaaaaacatatccttttcgttgccgtccggcagaaaaatccttccaagttcaattcagtcatagattaataactaacgagcattgtcaattgcgacctgtggtttatcccctaattctcaattttcaattctcaattttcaatttaaaacgatgagttatttattcacctccgaatcggtgtctgaagggcaccccgataaagtagccgatcaaatatcggatgctttgctggatgagttcttggcgtatgacaagaattcgaaagttgcttgcgaaacccttgttacaaccggacaggttgtcttggctggagaagttaaatcaagtgcgtatgtggatgtgcaggaagtggcacgtggcgtgatcgagaagattggttacacgaaaagcgagtaccagtttgaagcgaagtcatgtggtgtgttctcttctatccatgagcagagtggcgacatcaaccgtggcgtagagcgtgcggatccctatgagcagggtgccggcgaccaaggtatgatgttcggttatgctactaatgagactgagaattatatgcctttggcgttggacttatctcatagtttattatgggaattggcgaagatccgtaaggaagaaccggatttgatgccttatttgcgtccggacgctaagagtcaggttacgattgaatacgatgataacggtaagccgttgcgtatcgatacgattgtggtatccacgcagcatgatgagtttatcggtccgaaaggtatttcacagaaggaagcggatgaggctatgcaaaagaggatcgccttagacgtgaagaagatattgatacctcgtgtgaaggctcaatatccggctcatgtacaggctttgtttaatgataatatcatttatcacgtgaacccgaccggtaagttcgtgatcggtggtcctcacggtgataccggtttgaccggccgtaagatcatcgtggatacatacggtggcaaaggtgctcatggcggtggtgctttctctggaaaggacccttctaaggtagaccgttcggctgcttatgccgctcgtcatatcgctaagaatatggttgccgccggtgtggcggatgagatgctggtacaggtgtcttatgcgatcggtgtggctaaaccgatgaatattttcgtgaatacttttggccgtgcgaaggtgaatatgacagacggagagatcgccgcgaagatctgggatatcttcgatatgtgtccgaaagcgatcgaggagcgtttgaaattgcgtaacccgatttatttcgagaccgcttcttatggccatatgggacgcaaaccccagacggtgacgaagacattctcttcccgttatttgcagaagccggttacttgtgatgtggagttattcacatgggagaaattggattatgcagataagatcaaggacgtgtttggtctataaaaaataagtggaaaaagtaagctggcttaaatggcgaagtatgttaagatactttgccatttaagttaagatacttagccgatgaagttaagatactttgccaagtatgttaacttacccttcctcttggagcatttctacttcttttactttcctgaacaggtcggacgcaaagatgaaatcgttcaacgcttggttattagaggtgattacctgctcttttgttccttgccattccttcacgccttccttaataaagatgatattatcaccaatattcatcacggagttcatgtcgtgggtattgataacggtcgtcatattgtactccaccgtaatgtcgtgaatcaaatcatcaatcaatagagaagtcttggggtctagtccggagttcggctcatcgcagaacaggtatttaggatttagggagatcgctcttgcgatggcggcacgtttcatcatacctccactgatctcggaaggatatagatgtccagcctcggacaggtttacacgttccaaacagaattccgcacgtttcctgcgctctttcgttgagtctttagagaacatatctaaaggaaacattacgttttccattaccgtcatgctgtcgaataaagcggaaccttggaacaacatacccatttcccgacgcagcatatttaactcatacttgttcatcgtgatcaagtctctaccgtcgtataatatctgtccggtatcaggtttcattaacccgatgatattcttgatcattaccgttttacccgaaccgcttcgtccgatgatcagattcgtcttaccatcctcgaacgtcgtacttatatctttcaagacgacacgtccatcgaaagacttcgttatattcttaacttcgatcatttttaagtaagcattaaatgggttaatattacgtcggcaagtaaaatcatgatactgctcatgaccacggcattcgtacttgccttacctacctctagggcgcctccctttacgttatagccaaaataggcagcgatggatgagatgatgaacgcatatactacggatttgataatagaataccaaatgtaaaactcgttgaagtagaattgcaaaccgtactcgaacgaggaaggagtcattcccgtactcgttgagtaactggcgaatatgccgcccatgataccggtgaacatactgaagataaccaataccggaataaagatcatcaaaccgagcattttcggaaggatcaggaagttggctgaattaacacccatgatttccatggcgtctatctgctcagtgactcgcatggttccgatctcggaggcgatattactgcctactttacccgctaggattagtgccatgatagaggaagagaattccagcaagataatctcacgggtggtatagccgatcgtaaacttaggaatcaagggggaactgatattcaaggagatctggatggcgataaccgtaccgataaagaccgagatgattatgacaatccaaagagaatccacgcctagcttgtatatctctttgatcaattgcttaaagaacatactccaccggtctggaagtgttatactcttcatcatcagtagggtatactcacccattctgtgtaatgctttattcatttttatcttgataaatttctgatttcaatttgcaaagatagcgtaaaatccactaataaccatataacatcttagaaacaagattggttttatttgtaaatcctatggtattaaagtttgccacatccctcttttttaactatgtttgttttcttaaatactaaaaaatacttttatgaagcgaattcttttaggagtgatcggcttgctgtgtttatgtgtggcttgcctgcggaaggatctttcttttaagccgggggaagtttggccggatgataaaggggtacatataaacgctcatggtggcggtattctacgggttggggatacttattattggtttggtgaacataaaacggagggctcggctggaaatctggctcaagtaggcgttcattgctattcgtcgaaagatttatataattggaaagacgagggaatcgccttatcggtcgtgccggatgatacgacgagccatattgttaagggatgcgtgttggagcgtccgaaagtgatttataataaaaagaatgatcaatatgtaatgtggtttcatttagagccgagaggtgctggctattcgggagcattgagtggagtggctgtcagtaaaaacgtggcggggccttactcgttcgtaaacgctttccgtccgaatgccggtttttggccggttaatgtacaggaactacataagcaaccttgtacgctttccgcagatctacgttttagcggtggagagttacctgcccatccggatagcttgaatttattggggcgtgaccaaatctccggacaaatggctagggatatgaaccttttcgtggatgacgatggcatcgcttatcatatttattcctcggaagagaatagtaccttgcatatatcgcagctgaccgatgattatacgagttattccggtaagtacgcccgtttcttcccggggcgtttcatggaagctccagccttgttcaaacagaaggggaaatattatttgattatgtccggctgtacgggctgggctccgaatgcgggacgatcggcggtcgcttcctcgatttggggaccttggaaggaattggaaaatccgtttaggggagagaactcggaggtgtcgttttattctcagagcacgtacgtattgcctgtacccggccatgcggatcgctttatttatatgggagatcgttggactccggagaacgctatagacggacgttatatctggcttcctatccgattcgagggggagcaacccgtgatcgagtggcgatctgagtggagttattaaattctcttatcgcttttttgcgaatgtatgtgatgtagatctgcggattatcacgtacattcgcgttaaatttttaagtagcttatgtcagacgaacaacgaatggtgctccgtacggaggacttggtaaagaaatataggactcgtacggtcgtgaatcatgtatcgattaacgtgaaacagggggagatcgttggtttgcttggtccgaacggagcgggaaagacgaccaccttttatatgacagtaggtttggtcactcctaacgagggtaagatcttcttgaatgacatggagattacgaaattcccggtctataagcgggctcgcaacggcattggctatctggcgcaagaggcttcgattttccggaaaatgacggtggaagataatatccgctcggtcttggagatgacgggacgtagcattgagtaccaaaaagagaaactggaaagtttgatttcagagttcggtttgaataaggttcgtaaaaacttgggagaccagctttcgggtggagagcggcgtcgtgcggagattgcccgctgtctggcgatcgatccgaagttcattatgttggatgagcctttcgccggtgtagacccgatcgccgtacaagatatccagacaatcgtggctcgcttgaaacataagaatatcggaatcttgattaccgaccacaatgtgtacgagacattgagtatttgtgaccgggcctatctcctgttcgagggaaaagtccttttccaaggaaccgccgaacaactagccgagaacgagatcgtgcgcgagaaatatttgggaaaagactttgtgctgcgtaagaaagacttatagcagtcgtttcaatcgcctgtttacctgtatgaacagcaggaaagataaggcggcgataagacaaaagtccaaaagatgctcggcgggaatatcgcctgtgataaactcgttatccttgagacgactgtccgacatccctattacggcgaaagcattattgacaaagtgggcgaacaccggtatccagatgctcttgctccaatagagtagatagccgaaataggctccgagtatcatccggggcaagaatccgtaaaattgtaaatggaaggcgctaaatagtatggcggcgacccatatgatcgtatgagggttggaggtccatttcccgatcactcgttgcaaggctcctctgaacaggaactcctcggttatcccggccgtaacggcgataacgataaggttggccaggattacccaaacgctatcgctggataacaggatcgtcgtcagttgttcggcgagggtttcttgcgcccgcatccattcctcgataggagccataaacgcgggtaactccatctgcttgttgagcaatcctagcaaattgataaccggagaaaataagaacacgcaaactaaggtgagaatccagatcctgccgtctgtgattttcttgactgatagataatggcagggattgtcactacatatccaagccatggcgatagatggtagcaaaaaggtacagatcgccgagatgaactgaatgagcctcattaaattagcgtcttgggttatatcagcctgtaaaccgtgggtcgcaagtaataagcccgtggatataatagatgataaaatggctccagccaataagaatagcaagaggatcaaaagttggattatcgccggacgggtagcatatattccttttattctcataatgattcattcaaagggtaaataattgccgccaaatataaacaaaagaataaaaacagatcaaaatttgcacgattaaaagaataagtctaattttgcgacctaaaattcgatacgactattaattaaataaatcattcagaatgaacgtttcgcttaaaaacaatgatgccgtaagcggtatcgtgaaattagaaatagtgaaagctgactatgctgatcaggtagacaagagcctgcgtagccttcgtcagaaagccaatgtaccgggtttccgtaagggcatggttcctatgggcatggttaaaaaaatgtacggaaagcacgtgctggtagaggagataaacaaattagtttctgagaatctgttcaagtatatccgtgagaacgatttgcatatcttaggcgagccgatgcctaacgagactgagcaaaagccgttggatttcgataaggaagaggatttcgaattctgttttgacgtggctttggctccggagatcaatatcgagttgagcaagaacgataaacttccgttctatcaagtcgctatcgatgaagaaatgctaaataaccaagtaaacgcttatcgctcaaacttcggttcttacgacaaggtagacgaggttgaggaaaaagatatggtaaaaggtacggtagccgagcttgagaatggtgccccgaaagaaggtggtatcgttgttgaggatgctgtcttgatgcctatgtatatcaaggatgaggaagaaaaagctaaatttatcggtgctaaagtaaatgccgtagtggtattcaacccgaataaggcttacgagggtgctgaggcagagatcgcttctttcttgaagatcgataaagagaaagtggctgagactacaggcgactttagctttgagatcaaggagatcacccgtcataaagacgcagagatgaaccaagagttgttcgacaaggtatttggcgagaacgtggttaccagcgaggaagaattcaagaacaagatcaaggaagctttggcagagcaattcgctcctcagagtgacttcaagttcttgacggatactcgtgatatgttggttgagagagctggcgagttgaatttcgctgacgatttattgaaacgttggttgcttgccgctaacgagaagaatacgaaagagaagatcgacgaggacttccctcagatccttcaggatttgaaatatcagttgatcaaggagaacttggttaagaagaacggcttgaaggttgaggacgctgacatcgagaacttcgctaaacgtgtggctaaggctcagttcgctcaatacggcatgttgtctgtacctgaggacgtacttgacaactacgctaaagacatgttgaaaaataagcaaacacttcagaacatcatcgaccgtgcggttgaggagaaattggctgcttggttgaaagagcaagtggaacttgatgttaaggaggtaaccgctgacgagttcaacaaactttttgaataaaaagatctttactcggcctcttaggaggttgttttatatcaaaaaagggatttctctctaaaaatatcttagcggatagcgaaataaattgtttctttcagaaatttatttataactttgtttttccgttaagtcacagagggaaatccctttttacgtcttctcggtaaataaaagataggagaaaatatggaagattttagaaagtatgctacaaagcatttaggtatgagtggtacggctctggatagttatatgaacatctccagtagctatatctccccgacaattatagaggaacgacagctgaatgtcgctcaaatggatgtcttctctcggttgatgatggaccgtattattttcttgggcacgcaagtggatgattataccgctaacgtgattcaagcgcagttgttgtatctggattccagtgatcccggaaaggatatctctatttatatcaattcgccgggtggctctgtatatgcgggctacggcatttatgacacgatgcagtttatctccagcgacgtatctacgatttgtacgggtatggccgcctctatggcgtctgtcttattggtggcgggaaccaagggaaaacgtttcggcttgaagcactcccgtgtaatgatccatcaaccgcttggcggcgtacaaggacaggcttcagacatcgagattaccgctcgcgagatcttgaaggttaagaaagaactgtacaccataatctcggatcattcaggtagaccctatgaggagatcgagcgcgatggcgaccgtgatttctggatgaccgcggaggaagcgaaaaagtatggcatgatcgacgatgttttaacacgtaaataacaaaaacaacaataagaaactatggccaaaacaacaggcgatacatgtacgttttgcggcaggagtagccgtgatgttaatttgcttatcaatgggatctctggttgtatttgcgatgattgtgcccggcaggcgtatgagatcgtaaaggagcagacaggaggtaagaaaacttcttttggtttgaagcagaaagatctgcctaaaccggaagatatcaagactttcttggatcagtacgtgatcgggcaggatgacgcgaagcgttatctgtcggtatcggtgtacaaccattacaagcgtttacttcaaaaggttaccgccgatgatgtagagattgagaaatctaatattatcatggtgggcgctaccggtacgggcaagactttgttagcccgtacgatcgctaagttattgcatgtcccgttcgctatcgtggacgctacggtacttaccgaggcaggttacgtgggggaggatattgagagtatcttgacccggctattgcaagcggcggattatgatgtggaggcggcccaacggggtatcgtcttcatcgatgagatcgataagatcgcacgtaagagcgataatccgtctatcactcgggatgtcagcggtgagggtgtacagcaaggtttgctgaaacttctagaaggatcgatcgtgaatgtgcctcctcaggggggacgtaagcatccggagcaaaagatgattgcggtggatacgaagaatatcctgttcgtttgcggtggtgctttcgatggaatcgagaagaagatcgctcaacgcttaaatacccgtgtggtcggttattcggctagtttggatacggctaccgtagaccggaataatttactgaaatacatcaccccgactgatttgaagtcgtttggcttgatcccggagattatcggtcgtttacctatcctcacgtatctgaatccgctggatcgtgatacgcttcgtaacatcttgaccgagccgaagaactccattatcaagcaatacgtcaaattgttcgatatggatggcattaagctgacgttcgatgagaaagtctatgagtttatcgtggataaggcgcttgagtttaagctgggtgcccgtgggttacgttcaatcgtagaagccgtgatgatggacgctatgtacagtatgccatctcaaaaagtaaaggaactccatgtaacgttggagtatgcgaaagagaaatttgaaaaatcggacgtgaaccgtttacaggtcgcgtaaacgtaggcggtttactataaataatacgaagtatggcaaagaaggatcatttaacagaagagctaaatcggcactttggcttcggtacctttaaggggaaccagaaggctattattgagaacgtgctggccgggaaggatacttttgtattaatgccgacggggggaggtaaatctctttgttatcaattaccatccatactaatggaaggaaccgcgatcgtgatatctccgttgatcgctttgatgaagaatcaggtggacgcgatgcggaatttcagtgaggaagatggggtcgcccattttatcaattcctctttgaataagtcggctatcgaccaggtgaaatcggatatattatcaggacgtaccaagttgctgtatgtagcaccggagtccttgaccaaggaagagaacgtggattttctgcgtcaggtaaagatctctttctatgcggtggacgaggcgcattgtatctcggaatggggacatgatttccgtccggaatatcgaagaatccgtccgattatcaatgagatcggtaaacgtccgttaatcgctctgaccgctaccgctacacctaaggtgcagcacgatatccagaagaatctgggtatgatagacgctacagtctttaaatcatccttcaaccgctctaatttgtattatgaggttcgtccgaaaggaacgaatatagaccgcgagatcattaagtatattaaagccaacgagggtaaatcgggtatcgtatattgtttgagccgtaaaaaggtggaggaatttgccgacatcttgaaagccaacgggataaaggcgttgccttaccatgcgggaatggattcgcaagtacgttccgccaatcaggatgccttcctgatggaacaggcggatgtgatcgtggctacgatcgctttcggtatgggtatcgacaagccggatgtccgttatgtgattcattacgatatcccgaagagcctagaaggttattaccaggaaaccggtcgtgccggtagggatggcggagaaggccaatgtatcgctttctatgcttataaggacttgcaaaaattggagaaattcatgcaaggaaagcccgtggccgaacaggaaatcggcaaacagttgcttttagagactgcagcctatgccgagacttccgtctgccggagaaaagtgctattgcattatttcggtgaggaatacctggaagataattgtggtaattgtgataattgtttgaacccaaagaagcaggtggaagcgaaggaattgttaagcgcggtactggaggttatcagtacgttgaaagaaaagtttaaggcagattatatcgtaaatattttggtaggtaacgaaacctccgaaatccaaaattacaagcacaatgaattagaggtcttcggttccggacaggacgaggatgataaaacttggaacgccgttattcgtcaggctttaatcgctggctatttagcgaaggatattgagaattatggtttgctgaaaatcacggaaaaaggtaaggagttcatgaagaagccggtatcgttcaagattaccgaggacaatgaattcgaggaagaggaagaggaagttccggttcgtgggggcgcctcttgtgcggtagacccggttctttattccatgatgaaggatttgcgtaagaaattatccaagcggttggaagttccgcctttcgtgattttccaagatccctctttggaggctatggctactacttatccgatcacgttggacgagttgcagaatatcccgggagtgggcgctggtaaggcgaaacgttatggcaaggagttcattgagttgatcaagaaacatgtagaggagaacgagattgagcgtccggaggatttgcgcgtacgtacggtcgctaataagtccaagttgaaggtctcaatcattcagcggatcgaccgtaaggtggcgctggacgagatcgcgttgactaacggacttgagttcaccgagcttttggatgagatcgaggcgatcgtatattccggtacacgtatcaatatcgattatttcttgaatgatgtgatggatgaggatcatatcgaggatatttacgagtatttcaaggattcggagaccgacggtctggaagacgccattgaggaattaggcggtgactatacggaagaggagattcgcttggtccgtatcaagttcttgtctgaaatggcaaactaatgggagggtggcccggttccactctaaagaaaaaacaaataaagaagcttattgttccttccgaaagagatttatttttccttcggaaggaattttgttttcgttcggatgaaagtttattttcttccgaatcgaatttttaatttctcccgtatcgatttattgcgtgaaaagtcgtatatttgcgcgcaataatttttaaagcataagttctatgtcatttattgcagacagggtagttatggatgggttaacgtttgacgatgtattgttaatcccagcttattcggaagttcttcctcgtaatgtcgatctcacgacaaagttttcacgtaatatcacattgaatataccgatggtgtcggccgctatggatacggttaccgaggccaagttggctatcgctatcgcccgtgagggaggtattggtgtgattcataaaaacatgacgatcgccgagcaggcaaagcaggtccagaccgttaaacgtgcggagaatggaatgatctatgatccggtgactatcacgaagggcaagcgtgtggcggatgccttggcaatgatggctgaatataagattggcggtattcccgtggtggatgaaggcgggtatttggtaggtatcgtgacaaaccgtgacttgcgtttcgagaaggacatgaaccgttctatcgacgaggtgatgacgaaagagaatttggtcgtaaccggacaatctacggatatggaggccgccgctcagatccttcaggaacataagatcgagaagttaccggtggtcgatagccataataagttgatcggcttgattacctataaagatataacgaaagcgaaagataaaccgaaggcttgcaaggattcgaaaggtcgtttgcgtgtagctgccggtgtaggcgttacgttcaataccttcgagcgtgtagccgctttggtggatgccggggtggatgctttggtgatcgacacggcacatggtcactcaaaaggtgtggtggatgtcttgaaacagattaaggcgcaatatccgcatattgattgtgtggtcggtaatatcgctacgggcgaggccgctaaatatttagtggaagccggggcggacgccgtgaaggtaggtatcggtccgggttcgatttgtacgactcgtgtgatcgctggtgtgggtgttccccagttgtcggctatttacgatgtggcgaaggcgttggaaggaactggtgtgcctttgatcgctgacggtggcttgcgttactccggtgatatcgtgaaggcgatcgccgctggtggatcttccgtgatgatgggatctctgttggcgggtgtagaggagtcgccgggcgatacgattatcttcaatggccgtaagtttaagtcttaccgtggaatggggtcgttggaagctatgcaaaaggggtccaaggatcggtatttccaagatgtggaggacgacgtgaagaagctggttccggagggaatcgctgcccgtgttccgtttaagggttctttgtatgaggtcatttaccaaatggtaggtggtttacgtgcgggaatgggttattgcggggctcataatatcgaggagttgcataaagctcgttttactcgaatcaccaacgcaggtgtgcaagagagccatccgcatgacgtagcgatcacgcaagaggctccgaattatagccgcggtgaatagtaatacaagttttacgttttataaaaaacactaatttaatgggatagcatacttttcttgtcggctctccgttagattagtgttatttttgtaatgtatattcgtgctatggtaaaagaatttttgatgaaaaagttacttatttcattaggggtattcgcttgtgtgacagttaacgctcaaaccgcatccgattcggtcgttatgacggtcgctggaaaacaagtgcctttatctgaatttatttttatcgcggagaagaatggagaggtggatttatcgaatacaaagtccgtcaaaaactatgtcgagctatttaaaaattttaagctaaaagtagcggaggcggaatctttagggatcgaccagacatcctcattcaaaagtgagctggatggataccgggctcagttgatcgatagctatatgtcggataaggagggtgagaaagcggctgcccgtgcggtatatgaccgtggggatcactcggtagagttgacccacatcttattccgtttgccggagaagacggtctccaaagatacggtagctgtatatcaagaagccatgcgagtatacgaacgtctccagaaaggagaggatatggaaacagtcggaaaagctttggccgagaaggataaggagcatgtcgcttgcgaatatgtacgttgcttgctcccgatgcaatccctaaaagtgtttgaggatgccgcctattccttgccgattggcgtggtgtctgaaccggttcgcacgaaattaggatttcatttgataaaagtccatagtcgtaaacccaatccggggcgggtacatgtcgctcatatcttgatcgccttcccgaaagattccgctattcaggactcatcggcttttctggcaaaagcgcaagctatctataagcaagtacaagagggagctgattttggcgagttagcgaaagaatattctggggatgctgcttccgctaagaaagagggagtattaccttggtttggggtaggcgagatggtccagccttttgagcaagccgcttttgcgttgagcaagccgggtgatttatccgaggtggtggaaactcgttttggttaccatatcattaagttgatcgataagaagggacgcccttcgtttgaggaagaggaaaaagctttgtcgagacgtatggggcagggtgaacgtaacttcgagttatataaagctttcgacgatcgtatgaaaaaagaatacggatacgttttctatccggaagcctatgcggagctgcaagcgttatgtaatgattgtttccccacggacgaggcgttttatgagaaagcgaaggatatgaacaagacgcttatgcaattggatggaaaggatttcccgcaagcggagttcgcttattatatccaacgttgtccgttctcgacaaaaacgtatgcgggtgattttatgcaagagatctatgatttgtttatccgcgatatcgtaacgaccgccgagcgtaagaatctggagacaaaacatccggagatccctcatttgatgcaggagtaccgggatgggattctgttgtttgaggtcagcaaccgggagatctggagcaaaccctccgcccagcagaaggtgttggaagcgaagtggattgcggatttgaataaaaaatatccggtgactgtcaactggaaattattgaagaaactaaagaaataaaataaagatagatatgaggatagtcttcatgttcctaacgttcgttgtgttgttgggtgcctgtaaaggttctcagccagctgatactacggatgtcttggttagcgtgaaaggacgtaccctaaatcgttcggaggtgaataagctaataccccgggggatttcctccgcagatagtctgttgctggccgagggctttaccaagaaatgggtaaaggatgtattggtgtacgatgtggctttgcgtaacttaggggatgagaaagaggaggtcgataaattggtagaggagtacaggcgttccttggttcgttaccgttatcaggaacgattggtggaggagaagctgaaaactgatatccgggaaagtgataaattaaactattacgaggaaaaccagaaaaagtttatcttggataaaggcttgatcaagggattattcttgaaaatcccggttgatgccccgggacttaccgacgtcaaaaagtggtacaaatccacagatgtggcctctttagaaaaaattgagaagtatagtgtgcaaaatgccacgatttatgagtacttttacgacaaatgggttgatttcgatgaggtaatggataatataccgatccatgtgtcgaatccgaatgcgtttctgaaggcgaataagtatgttgaggtggcggatagcagttattgttatctgttgaatatcaaggaatatttaccttccggcagtgtggagccatatgattatgccagtccgcacgtcacggaaatgctggtcaaccaacgaaaagttgaattcttgaaaaaatttgaagacgagttatataacgatgcgatccggagcggtgacgtggaattccattccgagccgtgatctctaattttataaatgggtagacatgatgaaaaagattttaagtgtattctttcttgcctgttgttcttgccttgtaatggcgcaagacaatgtgatcgatgaaattgtgtgggtggtaggagatgacgctattttacgttcggatatcgagacgcaacgtttgtataatcaaaacgagggggtccgtttggatggcgacccgtattgcgtgatcccggagcagatggcgatacagaaactatatctgaatcaagctaagatcgatagtattaccgtgaacgagaaccaagtgatccagagcgtggatcaatggatgaacatggctgtgaaccaaatcgggtctcgcgagaaattggaggaatatttcggtaagaaattttcccagatcaaggatgagcgtaaggagatggtgcgggagcagcaggtagtgcaacagatgcagcatcaattgatcggcgagatcaagctgacaccttccgaggtgcgtaaatatttcagccagttgtctcaggatagcctgccgaacatccctacgacagtagaggtgcaaatcgttaccttggaaccgaagattccgtttgaggaaacagacgctatcaaggcccgcttacgtgatttcacggagcaggttaattccggtaagatggaattctctacgttggctcgtttgtactcggaagatccgggttcggcgtctcgaggtggtgagctgggtttcatgagcaagacacagctgttgccggagtttgcgaacgtcgcgttcaacttgaaagacccgaaacgtgtctcccagatcgtacagacggagtatggttaccatatcatccaattgatcgagaagcgtggagaccgtatcaactgccgccatatcttattgaaaccgaaggtttccgataaggagttggcggatgctaccactcgtctggattcattgtacaatgatttgcaggcgaataagttcacgtttgaggaagccgctacattcgtctcttatgacaaggatacacgtaataataagggtttgatggtaaaccaagattacgagagcagcaatatgggaacccctaagttcgagatgcaagaacttccgcaggaaatcggtaaggtggtatatggcatgaaagtcggagagatctccaagccttttaccatgttgacgaacaagcagaaagaggtagtagctattgttaagctgaaagctcggacggaaggacataaggcgaatttggccgatgacttccaagctttgaaagcgatcgtagaggctaagaaacgtgaggaattattgaacgactggatcacgaagaaacaaaaatcaacctacgtgcgtattagtgacggttggaggaattgtgatttcaaatatccgggttggattaaggaatgagactaattaacaggttatttctagcgctcttatcgtgtgctttatcggttggcgtatttgcgcaaacgcaagatagcacggtggtagccgccaaagatagtgtcgctcccaagaagacgaaggtctttttggagcatgcgaatacgctttcgttcgataaggagaggaacgccgaggctcaagtactgaatggtgatgtttgttttcgccatgatagttcgtatatgtattgcgatagcgcatatttctttgagcagaccaattccttggaagcgtttagtaatgtccggatggaacaaggggataccttgttcgtgtatggaaattacctgttttacgatggaaatacccagatcgcttatttgcgggagaatgtccgcatggagaatgggcaggttaccttgtttacggatagcttgaactatgagcgaatcccggatatcggatattatttcgacggaggtctgattgtcgattctttgaatcagctctcttctttttacgggcaatattcgcctagtacgaaattggctatcttcaatgatagcgtccgtctggagaatgagcaattcacgttgtattccgataccttgcattataatacggactcgaagatcgccacgatcctcggaccatccataatcgtctcggatagcggcacgatctattcttccagaggttggtacgataccgtgaataatacctctttgctattggatcgttctcaggtggtttccggcgaccgtatcttgacgggcgactctatcgcctacaaccgggaactgggttttggggaagcgttcggtaatatgagtctgcaagacacggcgcagcatgtcatgctggaaggccaatatggcttttacaatgagaagaccgagtatgctttcgctacggatagcgcccgtttcttggaattcagccaaggggatacattgtttctgcatggtgataccttgaagatgactacggtggactccctttaccgggaagtaaaagcttattacggcgtccgtttctatcggacggatatgcaaggtgtttgcgattcgatgcagtttaatacaagagactctatattatatatgtatacggaccctatcgtttggaatgaacagtatcagatctatggggatacgatcttgatatttatgaatgatagctcgatcgatttcgctcacgtgaagcaattcgctttcgcgatacagcaaatcgattctaccgcattcaatcaattaaagggaaatgacttgaaggcttatttcgagggacaggtcgtgaatcagatcgatgtgtcgggtaacgccgaatcgattttcttcccattggagaaggacggttcgatggtcggcatgaacgagaccaagagcggtttccttacgatctggctaaaagacaataagttggataaactgaagatctggccgactccaacaggtacgatgacccctattcctgatttgaagcccgaccagaaatacttgaaagacttttattggtttgattatatccgtcctaaagacaaggatgatatttatcaggtcgtgaaaagaaaagctcaagatgctccgaaaagaagcaataaattcgtacattagcgtcgtattcataattaataggtaaagctatggcacttttctcgttttataacatgcgcaagccgcgtcaatttgatcataagcctatttattgggacccccataaggaagccttggaggaacgtataagcaaggtcaaacgtgaaatgggtgtagaggagccgttggaggaatataagccgcatatcaagggaactttcattgaaggtacctcgcatctgaagaaaagcgtggggcgaggcgaggattcccgggctcgtaggtataagaatgtgaaactggcggtggccttggcggtcttggctgctttcttttggtatttgttctggtaatgagcgatatcattcatttacttccggaccatatcgccaatcaaatcgcggcgggagaggtgattcaacgtccggcctctgtcgttaaagagttggtcgagaatgcggtggacgctggcgcttccaatatccaagtgaacattaaggatgcgggtaagacattgatacaggtgatcgatgacgggaaaggtatgtccgagacggatgctcgcatggcttttgagcggcacgctacttctaagatttctacggccgaggatttattctctttgcatacgatgggtttccgaggtgaggcattggcctctatcgccgctgtcgcccatatagagttgcgtacccgggctagagggaccgagcttggcacttgtctatccatcgcgggttccaatttggagagtatcgagccggaggcttgtaacgagggaagtatcttctcggtaaagaatcttttctttaatgttcccgcccgccggaaattcttgaagtcgaatgagacggaattccggaatatcatcaatgagttcgagcgaatcgccttggtgaatccgcaggtgggtatgtctctttatcataatgacgcggagatattcaatctgcccgagtcggggttacgtcagcgcatcattaatatatatggtaagagtttaaaccagaagttgctctctctggatgcccaaagttccatggtgactatttccggtttcgtggggcgtccggactcggcgaagaagcgaggggcattgcagttcttttttgtgaatggtcgttatatgaagcatccttatttccataaggcgatcatgcaggcctatgagcaattgattcctgccggggatatgccgaattattttgtttatttcacgttggatccctcctcgatcgatgtcaatatccatccgacaaagacggagattaagtttgagaacgagcaaccgatctggcagatcttgatggccgctacccgggaggcgttggctaaatcgagcgctatccctacgattgatttcgacgtggaggatgcgatcgatattcctgtttacaacccggtcaagaaaagtgagcctagtacttataaggccccgaaagtgcaagtggattccagttataatccgtttgacactacttcctataaaaaaccggaattcgattggtctaaattatatcaagggtttgagaacgatcgagtggctgcccaactggagtccgagagtttcgaggatgccccgatcgaggaattgccagccgaggcttcgaacccggaaaacctgtttgcggaggtaagcaatccttgctatcaatataaagggcgatatatcgtgacatccttgaaatcgggtctggcgattattgaccagcatcgtgcgcatgtgcgtatcttgtttgaccaatacctgtcgaatatccgtcagcaacaaggtgtatcccaacaagtcttattcccggagatcgtagagtttaccgctgccgaggcggctgtactaccttccttattggaggatttgtgcttcgtcggctttgatctgagcaatctgggaaatgacaattacgcgatcaatggcctgcccgccggtatagagaaccttgatccggtaaatttggtaaaggatatcgtggaccgggcgatcgagaccggatgcgcagtgcatgagaagatctgcgaggccatcgccttgtctttagccaaagccgccgctatccgtcccggcaaatccttatccttggaagagatggatcatctgatcgcctccctgttctcttgttcggactcgaacctgaccccggatggaaagacgattatctccatgctgacagatgaggagctggagagaagatttaagtgctagggatgatttcgatgacataggtttcacggctgcatttacatttaggtttcccggacatgcggcccggaagcaggcgtggaacacatcttcctcgatcggacgtttatagaaagcctcattcgatcgcatgatcgcctcctcctttgcggaggtgaaccaatggcgctctcctttttgtaactcgtttttcagctgggcgtagatttgatcatgctcgataccttcgcaattaatcttgctttgcacctccacgcataggaaacggcggcttcccgtggggtcgcttaataggttcttctggttcgtagtgccaataaatgaggctaggcggggtagggggggaatgcttggcgtgtgccttgcgtacgttcattccggccatctgcatccaatttttcagtaaagccattttacggtcggacaaccggtcgaactcatcgaggttgatgagtccgaacaatccaagcttctgctccatttgcgtcgagccgctaaggtctacgctatccgtgtaatagcggactagcgaagaaggcatcagcgacttgcaaaaggtagacttctgacatccttgacgctcgctgactaaaatgggagccaagctatttgcgtgcattcggtccgaacccatccattgcgaggccaaggcgagcatccagcgatgaaacccctccacccataacggttctgaggagacccgtcgtgccagatcgcttacccggtctttcccgtcccattcgggtaaccactccatatattgccggaaaggatgatactcttttacttcttttgaatatacgaaacgattcacatcccgatccctgcaatcgatccccgtccgtcttgcctccatgcaaatgctatttaggtcacgttgcgtcaccggatagaagcgatccgtttccaattgtttgtatcgatattcagtctcctcgctcaacaagttgaagtggaattcgatccgttcttggaggaaagtctccagactcttttgaaggatagagttgctgttgctcgatcgtttcgctttaccttcgtttgggtgtggtacggtgatcgacccgtccggttttaagaagcgaagccataattggcctaaaaaatccaatacagttttcatgacgctatgttttagaggttgtttttactgtttcattttgcggatataagctgttaacttgcggttttccaaatgtttatattgtcatttgaaataaaagtaatctgtgcgaaatactagggaaaactattgtttaagtggtatggatgtagtacctttgttaagtgcttataatcttttcacctatgtgaaaagaacgtatcacaatcatgaaacgatcgtttcacataggtgaaaagatcatatcacccttgtgaaatgactaatagcatacgatgtttcgatgaataaccttttaatctcatactagatatatggcagcaaaatatgacttttacaagactccggtatcgaaggacagcacgaagcgtcctcgttttcacgcacgtatcgtatcatccggcacgatcgatacggatgatctggccaaacgtatccatggacggtgtaccgtcacgccggcagacgtagccgccgtgcttatctctttaagcgaggtgacagcggaatatttgcgtgaaggaaaacgtgtacatatcgatgggttggggtatttgcaagtcacgttgcaatgcccggccgtacaatccacgcacgagatacgtgcggagtccatccgtttcaagtccgtggctttccgtcccgaggtagagctgaaagatagcttgaagacgatgacgctggaacgagccaagtacaaatcccattcccgccaattggagcctgatcgtatcgaccaattgctcgcgagttattttgccgagcatgaatatatgacccgtgtcgccttccagcggctttgcggcctgacgagcagtacggccagccgccgcctgcatcaatttgtcgaggcgggtaaattgcgtgatatcggcacccgccaccagtcgctttacgtgccagtgaggtaaatagagatagtgaatgttaaatattaataaatatggctagggcctaccttgccaaacgggaacaaatatgtacctttgcaccgtttttagtgcggagtatgcgaaaaaaacaggcacaacttattgattgtccgaaaataatacgtaactttgcggctcgaaataggaaaagattagataaataataataacacattcaaagtttaaaaaaagaaagaaatgcctacaattcagcaattagttagaaaaggaagggaaactttggtggagaagggtaaatcacccgcattggacgcttgtcctcaaagacgtggcgtttgcgtacgtgtttacactacgactccgaagaaacctaactctgcaatgcgtaaagtagcgagagtacgtttgacaaatggtaaggaagttaactcctatattccgggagaaggacacaacttgcaagagcactctatcgtattggtacgtggtggtcgtgtaaaggaccttccgggtgtgcgttatcacatcgtacgtggtacgttggatacagcgggtgttaacggccgtacgcaaagacgttccaaatatggagctaagcgtccgaaaccgggtcaagcagcagctgccgcaaaaggtaagaagaagtaattaattacatgccttcaaactgagatttaaatttaagtattaaaacaggtttgagttatttggataggctataaggttgagtaaatggttcagcggaaccgttgaagacaaattaaaggcaaccaacgacaagaacaaatttttgaaaacaaaatgagaaaagcaaaaccaaagaaaagacagatccttccggatcctgttttcggtgatgtaaaggttacgagattcgttaaccatttgatgtatgatggcaagaaaaatactgccttcgaaattttctattccgctttggaaaccgttaagggcaaattgcctaacgaggaaaagtccgctctcgaaatttggaaagctgcgcttgataacattactcctcaagtcgaagttaagtcacgccgtgtaggtggtgctacattccaagtccctactgaaatccgcccggatcgtaaagagtcaatttctatgaagaaccttattatcttcgctcgtaaacgtggaggtaagactatggctgacaagttgtctgcagagattgtagatgctttcaataaccaaggtggcgcattcaaaagaaaagaagatatgcaccgtatggctgaggctaaccgtgcgttcgctcacttcagattttaatttttaaggcaataaaaagaatatggcaaacaacgataagcaattgatgttcactaggaacatcggtatcatggctcacattgacgctggtaagacaacgacttctgaacgtatcttgttttacacaggtttgacacacaagatcggtgagactcatgatggtactgctacaatggactggatggcgcaggagcaggagcgtggtatcacgattacttccgctgctacgactacattctggaactatttgggcaaccgttataaaatcaacttgattgacactccgggacacgttgacttcacggttgaggttgaacgttctcttcgtgtattggatggtgctgttgctacattctgtgccgtaggtggtgttgagccccagtctgagactgtatggcgtcaggctgataaatataatgtacctcgtatcggttacgttaacaagatggaccgctcgggtgctaactactatgaggtagtacgccaattgaaggacgtattaggagctaatccttgtccgatccagatccctatcggagctgaggagactttcaagggtgttgtcgacttgatcaagatgaaggctatcttctggcacgatgagactatgggtgccgagtatagcgtagaggagatcccggcagacttgcaagctgaggctgaggagtggcgcgacaagatgcttgaggctttggctgagtgcgacgacgctatcatggagaaatacttcgatgatccttctacgatcacggaagaggagatcatggttgctatccgcaagggtacgttggctatgcagatcaacccgatgacttgtggttcttctttcaagaacaaaggtgtacagactttattggatgcagtttgcgcgtttttgccttctcctgaagatactccggctatcgagggtacggatccttcagatcctgataaaataatcactcgtaaacctttgttcgaggagccattgacggcgttggcatttaagatcgctaccgacccgtatgtaggtcgtttgtgcttcttccgtgtatacgcaggttctatcaacgctggttcttatgtgttgaacactcgttccggaaagaaagagcgtatctcccgtttgttccagatgcactctaacaagcagaacccgatggaggtgattggttgtggtgatatcggagcaggtgttggtttcaaggatatccgtacaggtgatacgctttgcgacgaaaaccatccgatcacattggagtctatggaattcccggaaccggttatcggtatcgctgtagagcctaagactcagaaagacatggataagttgggtatgggcttggctaagttggccgaggaggatcctactttccgcgtacagacaaacgaggagacaggtcagaccgttattagcggtatgggtgagcttcacttggatatcatcatcgaccgtttgcgtcgtgagttcaaggttgaatgtaaccaaggccgtccgcaggttacttataaggaggctatcacgcagccggttgagcttcgcgaggtttacaaaaagcaatctggaggtcgtggtaagttcgctgatatcatcgttcgtatggagccggctgacgagagcttcgagggtactttgcaattcatcgatgaggtgaagggtggtaacattcctaaggaattcatcccgtccgtacagaaaggtttcgagaaggctatgaagaacggtgtgttggcaggttatccgcttgacaagctgaaagtgactttgatcgatggttctttccacccggtagactcagaccagttgtctttcgagatcgccgctatccaagcgttcaagaacgcttccgccaaggcaggtcctgtattgatggagccgatcatgcagatggaggttgttactccagaagagagcatgggtgacgttatcggtgacttgaacaagcgtcgtggacaagttgagggtatggagactagccgtacgggagcccgtatcgtgaaggctaaggttccattggctgagacattcggttatgtgacagctttgcgtacgattacttcaggtcgcgctacatcttcaatgcagttctcacactacgctcaagtatcctcttctatcgctaagcaagtattgacagaggtgcaaggtcgcgttgatttgatcaaataatatttagaaacatataataaatatgagccaaaagatcagaattaaattgaagtcttacgattattctctggtagacaagtctgccgagaagatcgtaaagacggtaaaggctacaggtgctatcgttagcggtcctatacctcttcctacgcacaaacgtatctttacagtgaaccgctctactttcgttaacaagaaatctcgtgagcagttcgaactctcttcttataagagattaatcgatatctatagctcaactgcgaagacagttgacgctttgatgaagctagaattacctagcggtgtagaagtagaaattaaagtgtaagtttttaacaattagtgaaatgccaggattattaggaaaaaaaatcggaatgacatccgttttcagtgccgagggaaaaaatcttccatgcactgttatcgaagtgggtccttgtgtggttacacagatcaagactttggagaaagatggctacgaagctgtacagttgggtttccaagagaagaaagagaagcacacgacacagcctgagatgggtcacttcaagaaagccggtgtagcacctcaaagacacttggccgagttcaagaatttcgaaactgagtacaagttgggtgacgtgatcactgtagatttcttggaagacgcaggtttcgtggatgtagtgggtacatcaaaaggtaaaggtttccaaggtgtagtaaaacgtcatggttttggtggtgtaggtcagactactcacggtcagcataaccgtgctcgtaagccgggttctatcggtgcttgttcttaccccgcaaaggtatttaagggcatgcgaatgggcggccagatgggtaacgaacgtgtaaccgttcagaatcttcaagtgatcaaggtaatgccggaacacaaccttttattggtaaagggatctgttccaggagcaaaaggttcaatcttattaattgaaaagtaatggaactgagcgtatttaatattaaaggtgaagataccggaagaaaggtaactttgaacgatgcgatcttcggcattgaacccaacgatcatgctatttacttggacgtaaagcagtatttggcaaatcaacgtcagggaacgcataagtctaaagagagaagcgaagtatctggtagtacacgtaagctgatccgtcagaaaggtggtggtggcgcacgtcgtggtgatatcaactctccggtgttggttggtggtggccgtgtattcggtccgaagcctcgtgattatgagttcaagctgaacaagaaagtaaaatctttggctcgtaagtcagcattgagctacaaggcaaagaacaatgcgattgttgtcgtagaggatttcacaatggaagctcctaagactaaagaatttataacaattgctaaaaacttgaaagtggctgataaaaagttacttatggttttaccggagaagaataatttagtatatttgtccgctcgaaatttagagaaggcaagtgtaataactgcttctgaactaaatacatacgctgtgttaaacgctgttaatttggttttaacggaaagttcagtcgctgttgttgaacaaaattttaaagcataaggagtagaataatgggaattattattaagcctatagtaactgagaaacaaacagcgatcacagagaaatttccgaatcgctatggttttcgtgtttctcctgatgccaacaaattggagattaagaaagctgtagaggatatgtacagtgttacagtagttgatgttaacaccatcaactactctggaaagcgtaaaagccgttatacaaaatcaggtatcatcaacggcaagcaagctgctttcaagaaagcgatcgtaacgttgaaagaaggagaaacaattgatttctttagtaatatctaaaaagagaaatgggaatacgtaaattaaagcccacgacaccggggcagagacacaaagttattggtgcatttgataaaatcactgcaagtacaccagagaagtctcttgtagtaggtaagaagagtacaggtggacgtaacaacactggtaagatgacaatgcgttatatcggtggcggtcacaaacaaaagtacagaattatcgatttcaagagaaacaaagatggcattcctgcgacagtaaagtctatcgagtatgatcctaaccgttcatctcgtatcgctttgttgtattatgcggacggagcaaagagctatatcatcgctccgaacggattggaagttggccaaacagtggtttcaggtagcgacgccgctcctgaggtaggtaatactttgcctatggcaaatattcccgttggtactattattcacaatattgagcttcgtcctggacagggtgccaaaatggtacgttccgcaggtgcattcgctcagctgacttcaaaggaaggcgcttatgcgattattaagatgccttctggtgaaactagaaagattcttgcggcttgtaaggctacaattggcgcagttggcaattcagaccatgctcttgaaaaatcaggtaaggccggtcgctctagatggttaggtcgtcgtcctcgcaaccgtggtgttgttatgaacccggttgatcacccaatgggtggtggtgaaggtcgttcttccggaggtcatcctagatcccgtaatggcttatatgctaagggcttgaagactagagctcctaagaagcattcttcaaagtatattattgaaagaagaaagaaataatctgattaattaagtaaactatgagtcgttcgctaaaaaaaggcccgtatattaatgtaaagcttgagaagaaagttctggcaatgaatgagtcaggaaagaaagccgtagttaagacatgggcaagagcttcaatgatttcgcctgatttcgtaggccatactattgcagttcataatggaaataaatttattcctgttttcgtaaccgagaatatggtaggccacaagttgggagagttctcaccgacacgtactttccgcggtcacgccggtaacaagaagaaataatatcggtagtaacaggaattcaggaatctgaaaataaaaagaatcgaataaaatgggtgctagaaaaagaatatcagctgaagcaagaaaagaagcccaaaagaccatgtatttcgcgaagttgaacaatgttcctacctctcctcgtaagatgcgtttggtagcagacatgattcgcggtatggaagtattccgtgcgcttggtgttttgaagttttctaacaaggaagctgcagcaagagtagaaaaattgcttcgttcagcaatcgcaaactgggaacagaaaaatgaacgtaaagcagaagcaggagagttatgcgtatcttcaatcagcgttgattgcgctactacgttgaagagaatgcgtccggctcctcaaggaagaggttacagaattcgtaaacgctcgaaccacgtaactctgtttgttgatacacttagtaaaaacgatagtcaaaattaatttgtagatgggacaaaaggttaatccgattagtaatcgtttaggaattatccgtggttgggattccaattggtatggcggtaagaattacggggatactttgctggaagatagcaaaatccgtaaatatttgaatgcccgtcttgcaaaagctagtgtatctcgtatcgttattgaacgtacgcttaagttgatcacgatcactgtttgtacgtcacgtccgggtatcatcatcggtaaaggtggtcaggaagttgataagttgaaggaagagttgaagaagatcactgataaagaagtgcagatcaacatcttcgaggtgaagagacctgaattggacgctgttatcgtagcaaacaacatcgcacgtcagcttgaaggtaaaatcgcatatcgtcgtgcggtaaagatggctatcgcctctaccatgagaatgggcgccgaaggtataaagattcaaatctctggtcgtttgaatggcgctgaaatggctcgttcggaaatgtataaggaaggaagaactccgttgcacactcttagagcagatatcgactatgctttggctgaggccttgacaaaagttggtttgctgggtgttaaggtttggatctgccgtggtgaggtttatggcaagcgcgatcttgctccttctttcactgctgccaaggagacaggccgtagaaacgacaatgccggtggcaacagagacaagaacttcaagagaaaaagagctaatcgttaaacgttagaatttaagtagagatgttacaaccaaagaaaaccaagttcagaagacagcagaaaggtcgcatgaagggcgaagctcaacgtggcaaccagctggccttcggttcttttggaataaagtcattagagaataaatggattaccggtcgtcagatcgaggctgcccgtatcgccgttacacgttatatgcaacgtcaggggcaggtttgggttcgtatcttcccggataagccaatcacgaagaagcctgcagaggttcgtatgggtaaaggtaaaggtaatcctgagggatttgttgcgcctgttactccgggtcgtctgattttcgagatcgaaggtgttccctttgatatcgctaaggaagcgttgcgccttgccgcacaaaaacttccggttacaaccaagtttgttgtgagacgtgattatgacatgcaaaatcaaaatgcgtaattgttatgaagattgcagaaattagagaactaagcacgaaagagttgctagagagagtagatgcagaggttgcggcctatgatcagaagaagattaaccatagcatctcgcctatggataatccttctcagattaaacagcaacgcagattgattgcgcgcatgaaaacagaattgcgccagagagaacttaacaacaaataattgagcctgatggaaactagaaatttaagaaaagaaagaacgggcgtggtaacgagcaacaagatggataaaagcatcacggttgccattaaatggaaggaaaaacaccccatttatggaaagttcgttaataagacgaagaaatatcatgctcacgacgaaaataacgaatgcaacattggcgataccgtaaagattatggagactcgtcctttgagcaagactaaaagatggagattagttcaaataatcgaaagggctaagtaagatgatacaacaagaatcaagactagtagtagcagataacagtggagctaaggaagctttgtgtatccgtgttttgggcggaacgagaaagcgttatgccactgtaggtgatgtgatcgtagtagcaatcaaaagcgtaatcccagctagcgacgttaagaagggtgctgtttctaaggctatcatcgttcgtactaagaaagagatccgccgtccggatggttcttatatccgtttcgatgataacgcttgcgtattattgaatgccggtggcgatatccgtggtagccgtatcttcggtccggttgccagagagcttcgtgcaacaaacatgaaaattgtatcacttgcacctgaagtgctttaatctcgtaaaatttaaagtaatgagtaaattacatatcaaaaaaggcgatatagtatttgttaatgccggcgaggacaaaggtaagacaggtcgtgttttacaggtacttgtaaaagataatcgtgcgattgtcgaaggtattaatgtggtatcaaagcataccaagcctaatgcgaagaatcctcaaggaggaatcgaaaagaaggaagctcctattcatctttctaaccttaacgtggttgacccgaaatctggtaaagctacacgtatcggccgtaagttgaatgagaagggtgctttagtgcgttattctaaaaaatcaggggaggaaattaagtaatgagcaatactgccagtcttaagaaagaataccaagacagaattgttcctgccttaacgaaggagttcggttacaaatccgtgatgcaggtacctgttttgaagaaaatcgtgattaatcagggattaggtatggctacggctgacaagaagatcatcgatatcgctatcagcgagttgtctacgatcaccggtcaaaaagctgtcgctaccgtatctaaaaaggatatctctaactttaagttgcgtaagaagatgccgatcggtgtgatggtgacattacgtcgtgagcagatgtacgagttcttggagagacttgttcgtgtcgctcttcctcgtatccgcgacttcaagggaattgagagtaagttagacggaagaggcaattatacactcggtattcaggaacaaatcatttttcctgaaataaatatcgataatattaccaaaatattgggaatgaatattacctttgtgacctctgcgaaaacagacgaagaaggttatgctcttttgagagaatttggattgccttttaaaaacggaaaaaaagactaagtagttatggctaaggaatcaatgaaggcccgtgaggttaaaagagcaaagcttgttgctaagtatgccgctaaaagagctcagcttaaggcagaaggtaactatgaggctttgcaggctttacctaaaaatgcttctcctgtacgtttgcacaaccgttgcaagattacaggacgtccgaaagggtatgtacgccagttcggtatttctcgtatccaattgcgtgaaatggcatctaatggtttaatcccgggtgtaaagaaagcaagttggtaagagtttttttagtttaaatattgtccgggtggccggatcaatttaattaattatttatatgacagatcctattgcagattatttgacaagattgcgtaacgcaatcaaagcgaagcacagagttgttgaggtgccggcgtcaaatttaaagaaagagatcactaagatccttttcgacaagggctacattcttaattttaagtttgtagaggatggtcctcaaggtacgatcaagatcgccttgaagtatgacctagtaaacaaagttaatgcgattaagaaacttgagagagtttctacgcccggtttgcgtaagtacactggttacaaagaaatgccgagagtattgaatggtttaggtattgctgttctttctacttctaaaggtgtgatgactgacaaagaggcccgcgatctgaagatcggtggcgaggtattatgttacgtttattaattaggagggaagaagaatgtcaagaataggaaaattaccaattcatgtaccggctggtgttacagttacaattaaggataatgtagtaacagttaaaggccctaaaggtgaacttgtacaggaagtgaatcctgatattaacgttactttggaagacggagttatccatttaacaagacctactgatgataagaatcatcgtgcgttacacggtttgtatcgttctttgatcaacaacatggttgttggctgctcagagggatataagaaggagcttgagttagtaggtgttggttaccgtgtttcaaatacaggtcagttattggatctttctttaggttatactcacaatatctatttgcagttgccgaaggaagtgaaagttgagacgaagtctgagagaaataagaaccctcttattatccttgaatcggctgacaaacaattattaggtcagatttgtgcgaagatccgttcattcagaatgcctgaaccgtataaaggtaagggtattaagttcgtgggtgaagagattcgcagaaagtctggtaagtcagcaggtaagtaatctacgtaaactgaaattatcatgacaacgaagctagaaagaagattaaaaataaaagcaggcgtacgcggcaaaatctcaggaactactgagcgtccgcgcctgactgtgtttagaagcaacaagcaaatctacgcacaggtgatagatgatactacaggcaagactttagccgctgcttcatctttgaaattagatgttaaggctccgaaaaaggagatcgctgctaaggttggtgaattaatcgctaaaggcgctcaggaagctggcgttcagacagtggttttcgaccgtaatggttacctgtatcacgggagaattaaagaattagcagatgctgcacgtaacggcggccttaaattttaatgaagatggcaaataatagagttaaatcgaccaacgacttagagttgaaggacagactggttgcaatcaaccgtgtaactaaggttacaaaaggtggacgtacattcagttttgctgctatcgttgtagtaggaaacgaggatggtatcgttggctggggattaggtaaagccggtgaggtaacgacagctatcgctaaaggtgtagaagctgctaagaagaacttgatcaaggttccggtacacaaaggtacgatccctcacgaacaattagctaaattcggtggtgctcaagtgctgattagaccggcatctcacggtaccggtgttaaggctggtggtgctatgcgtgccgtattggagagcgtaggtattacagacgttttggcaaaatctaaaggttcttccaaccctcataacttggtgaaagctactatcgctgcgctaggtgagttgagaagcccgttcgatgttgctcagaacagaggtgttgctgttgaaaaagtatttagaggttaattagggggggataagtttatggcgactattaaagtaaagcaagttaaaagtagaattaaatgcccgaaagaccaaaagagaacgcttgacgcactagggctgagaaagatgaaccagattgtagagcatgaagctaatccggcgatcttaggtatggttgagaaagtgaaacatttggtttctgtagaaaagtaataattggttgaaaaaataaattatacgatatgaatttatcaaatttaaaaccggctgaaggatctaccaagaccagaaaaagaatcggacgtggtccgggttcaggattaggcggaacttcaacaagaggtcataaaggtgccaagtctagatctggctacaagaacaagattggtttcgaaggtggtcagatgcctattcaaagacgtttgcctaaattcggtttcaagaatattaaccgtgtagaatataaagctattaatatcgatactttgcaacaaatggcagaggctaagcaattgactaagattggtattaatgaattgatggaggctggtttcatctcttcttctcaagtggttaaaattcttggtaacggtagcttgaccgctaagttagaggttgaggctcacgctttctctaagagcgcagaggcagctatccaagccgcaggtggaacagtcgttaaactctaagtcatgagagctgttgaaacaatcaagaatatctggaagattgaggatctgagaaatcggatcctcaccactcttttattggtggctatataccgttttggtacgtatgtagtgcttccgggtatcgatcccaaagcgttaaccgctttacaggagcagacaagaggcggattgcttgcactgttggatatgttctcaggtggagccttttctaacgcatctatttttgcgttgggaatcatgccatatatctccgcttcaattgttatgcagttgttagccatcgcagttccttctttccaaaaattgcagagagagggtgagagtggccgtagaaaaatcaatcagtggactcgttacttgacgatagcgatcttgttattccaaggtcctacttacttggtgaatttaagcgttcagcttaaggctgccggcgctgctttaccgggtggtatttggttcacgatctcatctacgatcatcttggctgcgggaagtatgtttatcttatggctaggtgaaagaattacagataaaggtgttggaaatggtatttcatttatcattttagttggtattatagcccgtctgccgcactctttgttccaagaattcgtttctagaacaagtgagaaaaccggtggtctggttatgttcttatttgagatgttgttccttttgcttgttatcgctggtgcgatcttattggtacaaggtactcgtaaggtccccgtgcaatatgcgaaaagaattatcggtaataaacaatatggtggcgcgcgtcagtatatccctctgaaggtgaatgccgctaacgtaatgcctatcatcttcgctcaggcgatcatgtttattcctatctcaattgtaggtttctctagtacgggagagcagagcggtttttgggctgctttcatggataatacgggattttggtacaacttcgtgtttgcggtgttgattatcctgtttacgtatttctatacggctattacgatcaatccgacccagatgtcagatgatttgaagagaaacaatggttttattccgggtgtgaaaccgggtaagaataccaaagactatctggataccattatggaccgtattactttgccgggtgcttttttccttgcgttggttgctatcatgcccgctttcgctagaattgccggtgtaagtatggagttctcccaattctttggtggtacatctttgttgattttggttggtgtggtgttggatacattgcagcaagttgaaagtcatttgctaatgcgtcattatgacggtttgttgaagtcaggaagaattaaaggccgtacaggctctgttgccgcttattaatagaatgatctatttaaagacagatgaagagattgagttgatgcgtgaggctaatcaactggtaggtaagacacttggcgaggtagctaagcatattgtccccggagtctccacacttcaacttgataagattgcggaagagttcattagagataatggtgctgttccggcttttttgggatatggtggtttccctaattcaatatgtgcctcagtgaatgatcaggtggtgcatggtattccttcttctaagatgatcttgaaagagggtgacgtgatctctgtggattgtgggacgatattgaatggttttgtcggtgactccgcttacactttctgtgtaggtgaggttgcgccggaagtgaagaaattgttgaaagcgacgaaggattcactttatttaggtatccaatgtgctgttgaaggtcaccgtttgggtgatatcagtaatgcgattcagacttattgcgagtctcaaggttactctgtcgtaagagagctggtgggacatggtataggtcggaaaatgcatgaggaaccggaagtgcctaattatggcagacgtggatgcggaccgttattgcgtaacggaatgtgtatctgcatcgagccgatgatcaacatgggaagcaagaacgttgcatttgagaaagacggatggacggttcgcacaaaggacagaaagccttctgctcatttcgagcattgtatcgctatacgtccggatggtccccagatcttatcttcatttaagtttttagaggaagttctaggagaaaacgcaatttaattggatttatatggctaaacaatcagcaatagagaaagatggagtaattgtagaagcattgtcaaacgcgatgtttcgtgtagaattggagaacggacatgaaattaccgctcatatctcaggaaagatgcgtatgcattacattaagatccttccgggggataaggtaagagtagaaatgtctccgtatgatctatcgaaaggtagaattgcttttagatacaaataaaattaaacacgatatgaaagtaagagcatctttaaagaagcgtacacctgagtgcaagatagtaagaagaaagggtcgcttatacgtaattaacaagaaaaatcctaagtataaacaacgtcaaggataatttattatttttgcaaaataatctaagtaagtaatatggctataagaatagttggtgtagacttgccacaaaataaaagaggagaaatcgctttgacttatatctatggtattggtcgtagcgctgcaaaatccgtattagataaggctggggttgatcgtgatatcaaagttaaggattggacagacgatcaagccgcaaaagttcgtgaagtcattggcgctgagtacaaggttgaaggtgaccttcgttcagaagttcagttgaacatcaagcgtctgatggatattggttgctacagaggtgttcgtcaccgtgttggtctgcctttgagaggccaaagcacaaagaacaacgctcgtactcgtaagggtaagaagaaaactgttgcaaataagaaaaaagctactaaataataagagttaatatggcaaagaaaacagtcgcagcaaagaagagaaacgtaaaagttgacgcttacggtcaagctcatattcattcttcttttaacaacattattgtgtctttagcgaatagcgaaggacaagtaatcagctggtcttccgctggtaagatgggattcagaagctctaagaagaatactccttatgcagctcagatggcagcacaggattgcgctaaagtagcttatgatcttggtttaagaaaggtgaaagtattcgttaagggtccgggtaacggtcgtgagtccgctatcagaacgatccatggcgcaggtatcgaggtaacagaaatcgttgatgttacaccgcttcctcataacgggtgtcgtcctccgaaaaagagaagagtataattaattatagtttcttaaacattgaatccggaattgtgaatagattgcatattgaccttatcctctctgtaatcgcggctgcacggttccagattcaaacagaacatttaaaaaaataaaaaaatggcaagatatactggaccaagaacaagaattgcccgtaagtttggtgaggcaatattcggtgcggataaagttctttctaagaagaactatcctcctggacaacatggtaactccagaaaaagaaagacttctgaatacggtatccagcttcgtgagaagcaaaaagcaaaatacacttatggcgtattggagaagcaatttagaaacttattcgaaaaagcttcacgctctaaaggtattaccggtgaggtgcttcttcaattgttagaaggccgtcttgacaatgtggtttatcgtttgggtatagccccgacaagagccgcagctcgtcagttggtttctcatcgtcacattacagtagacggaagtgttgtaaacattccttcttactctgtaaaacccggtcaggttattggtgttagagaaaaatctaaatccatggaggttattgccgacgcattgtcaggtttcaatcacagcaaatatccttggattgagtgggatcagtcctcaatgagcggaaaattactgcatctgccggaaagagctgacattcctgaaaacattaaagagcagttgatcgtagaattgtattctaaataataattgatttccatggcgatattagcatttcaaaaacccgataaagtattaatgttggaagcggacaatttcttcggaaagtttgaatttcgtccgttggaacccggctatggtattacaataggtaatgctttacgtcgtattctcctgtcgtcacttgaaggttttgctattacatccattaagatcgacggggttgaccatgaatttggtacaatcccgggtgttatcgaggatgtgacaaacattatcttgaatctgaagcaagttcgtttcaagcatatcgtagacgacatcgagaatgaaaaagtgagtattactgtttcgggttcggaagtgttcaaagccggtgatattggtaagcaactgactggattcgagatattgaatcctgatttggttatttgccgcttggatccgaccgcaagtttccagattgaattgactattaataaaggtcgcggttatgtacccgcagatgagaacagagacccgaacgcagatatacatgtgatcgctatcgactctatcttcactccgatacgtaacgtaaaatattcaatcgagaacttccgtgttgaacagaagacggactacgagaagttggttcttgaaatagccacagatggttctattcatccgaaggaagcgttgaaggaagcagcgaagattctgattcatcatttcatgttgttctcagatgaaaagattgcgatcgagacagcggatactgaaggcaatgaagagttcgatgaagaagtacttcatatgcgtcagttgcttaagagcaagctggctgatatggacctttccgttcgtgcattgaattgcttaaaggccgcagatgttgaaacactaggtgagttggttaagttcaataagaatgatttgttgaaattccgtaacttcggtaaaaagtcgctcactgaacttgatgaactgcttgagagcttgaacctttcattcggtatggatatcacaaaatataaattagataaagagtaagtaaacgatgagacataataagaaattcaatcatttaggtcgtacaaatactcaccgtgacgcaatgctttcgaatatggcttgttctttgatcaagcataagagaatctttactacgacagcaaaggcaaaagcgctacgtaagtatgtagaaccacttatcacgaagtctaaggaggatacaactcactctagacgtgtggtatttagcaatttgcaagacaaatttgctgtaacagagttgttcaaggaaattgctcagaagatcggtgatcgtccgggtggttataccagaattatcaagactggtaaccgtttaggtgacaacgcagctatgtgctttattgagttagtagactataacgaaaatatgttgaaggatacagccgctaagaaagctcctaaaacaagacgttctcgtaaaaaagcaacagcatcggttgcagaagctcctacagctgaagcagctagcgaggaaaaagcagctgaataagcaagttttttataatcatataagaaaagcgattcgtacacacggatcgctttttttgttgaggtatagtgcaaatatagcagtgtaaagaaatatgaagtttataattgtttttattgtatgctttgaagagcctcctgcgctaccttattagaaggatcgatctctaagaccttattccagtatatttttgaattgtccagatctttttgaggtaatagaaatagcccagataacgatagtattcggctagtttcactgcttttgagagattctctaaagatggttcatattgctgagtcgcatttaataagcggtcttggtataaataatcttgccaaatgaactttccattaggcgtgttgaaaaatccagaggtttgttgtatgccattatcataatctttcgtctcgaaagcgttgtacaaattcagacgttgcggtaagaaattatccggttcagtggaaagcccttttgcgatgacttctccatcctcttgatcaaaagagtatccggtatggtgattatcatcaatatgatcttcacaagaagagcacaggcaagctttatattccggagggacagatgcggtatccgcataaatgaactcccctttgccaaacagcaggaataaatctagaagagtcaatagtggtaagtacctttttcatcttagtatgagtatattctttcataaacaacaaaagctttttttgaaaggtttaggcaaatagtaaaaatcatctattaaaagattgaaaaactcgataggcttccgcaaacattccttgcttggctattgttatatttgtgaaaaagaaaagtaagacatcattgaacaactaataaaacaaatatagtaatatggaaattgtaaaagtagtaggtagagagatacttgattcacgtggtaacccgacagtagaagtagacgtacatttggcttccggcgcattcggtcgtgcggctgtaccttctggcgcctctaccggtgagaacgaggctatcgagttacgcgatggcgataagaatcgctacggtggcaaaggcgttctccgtgccgtggataatgtaaataaggtaatcgctcccgccattttaggaatgagcgccttgaatcaaagagagatagaccataagttgctggatttggatggtacaaagacaaaatcaaatctaggagctaacgctatgttaggtgtatcgcttgccgtagcgaaggcagcggctaattatctggatctgcctttatatcgttatatcggtggaacaaatacctacgtgttgccggttcctatgatgaacattatcaatggaggttctcactccgacgctccgatcgcttttcaggaattcatgattcgtccggtaggtgcgaagagtttccgtgaggggcttcgtatgggcgcagaggttttccatgcgttgaagaaagtattgcacgatcgtggcttgagcacggctgtaggtgatgagggcggtttcgctccggcattggatggtacggaagatgccttgaattctattatggccgctatcaaagccgctggatatgagccgggcaaggatgtgacgatagccatggattgcgctgcttccgagttttatcacgatggtgtttatgattatacggaattcgagggtgagaaaggcgctaagcgtaacgcccagcaacaagtcgcttatctgagtgagttggtgaacaaatacccgattgattctatcgaggatggtatggacgagaatgactgggccggttggcaaatgctaacctccacgctaggcggaaaatgccagttggtaggtgatgacctattcgttacaaacgtagagttcttgaagaaaggtatcgagaagggttgcgcgaactccatcttgatcaaggtaaaccagatcggtacattgagcgagacattagacgctatcgagatggcccaccgtaatggctatacatccgtgacttcccaccgttccggtgagacagaggatgctacgatcgccgatatcgccgtagctaccaacagcggacaaatcaagaccggctccttaagccgttccgatcgtatggcgaaatacaaccagttgcttcgtatcgaggaggaattgggttccttggctgtttatggttataagacttataagaagtaattttcattatttgcttgagaaatgggggagttcacctatcaaggtggactccctttttctttttagtggaaaaaacgaagcaaacctactaatcaatagccagcctgctccaaacatttaatgattataaatctattgccctaaataagagagtgaatgttgtatctcttctctagagaccgagaagttcctgttcccggccaatttatttaatacgagtgtgcctatgttttctgcgctttccttatccgggaacgcaattaccgtatcaatagagggaatggtgggttggtaaatcaacacctttccgttcatcctaatctggtacccccagccatcccccgattgaaatgtttgcaactccagttgccgcccgggagaagaccccatttcttcaccccggaaaaaagataaataaaacagtaataccggcagtaccactaggcccggtacgaaccaagcccgtcctttcttagtattcatcatcgtcatattcattcgggtgaaattcccaaatatcatcaaattgagtggtaccacttttgccggatactacgaatcctttctcgccagaggagaaagatgctgtcgccgtacgggcagttcccttgaatttagctacgttttcccatagatcggtggccggataatatttccaagtgtcgctacgtaggcttccgctctcaccgcaagtcagataagcggctccatcaatcacgaaagcaaccccgttcgtacgtgtgatcgtataatcatcgtcataatcctcgtccgaggaatccgatatatccctaagttgggtccatgattccgtgctgggatcgaatttccagaaatcgtctacatattcgccgttattttgtccgcaacatacataagcgattccatttatcacgaagctggtagcgccctgacgctttgtcccgccgatactgatcgtttgcgtccagctatttgccaccggattaaaggcataaaagtcttttaggtaattcccgtcgtatccgcatccgatatacgctttaccgtttaccccgaaggccacggctccatatcggcccgagccggggaaatccgctttctgtgcccacgtattggtggtcgggttaaattcccagaagtcgttcaagtaattggtaccgtcgtatccggttcccagatatcccttttcatctaccgccatagctacggccgaattgcgggcggttccgggaaagtccgccttttgcgtccaagtatctcgttccatatcatattcccaacaatccgataaacgattttttccgtcgtttccgcaaatcagatatcctttgttaccgatcgtgaaagaggaggcgtaatttcgcgccaatccgtccatgtcagagacacggtaccacttaccgatcaaatcatcgtcatcgtcatcactgcaagcgctgatgatgacaggaagaaaagcgatcaagaatacaagaatccttttgtgtatcattctaactacgtattttgtttttatggaagcaaaagaacgagggttttacgagacccacaaattaaatcggtaaacatacggtttttatcggtgaataagccggattgataggttagggcctcgaatggttttgaaatcggtttcatcttcagtatcgggccgtttacagaggaaaccggtgggttcatgggtttatcttgccgggttttgcactaaatacgttctttgccatcggattgataaaagattattcgcttattaaataagaagtatggttagaacattctttgctttggggggcttgatgctctgtctgggactgttttcctgttatgacgagaacggtacgtatggcagcgatctggtggactccgctttccgtaacgttcgtatagataccagcacggtcgtagtgacctcggtattgatcgactcgttggagacatctggtaagaacgtcgctttggtaggccggtacaaacattcattatggggagtcgtctcgtcgcatagctttatcgcttatgaaagacctagctatgggactgatccggacgagacggtcgtactggactcgctagtcctgtctctcgctttcgacggtcgctttgtaggagacacgaccctccaacaaaccctctcgatttatcagctaacggagaagatcgtcttaaacgataacgggtatttatataataatagcagtgtctcttacgctcccgaggctttggcggtctgctcatttaaaccgaagccgaaggggggggagaaactggaagtccgtcttcccgatgcgctagggcaagacctcttgtcccgttttcatgcgcaggatcaagcggtgtccgaggagcgctttgaggattatttcaaaggggtggcgatcgtgccggacttggcaggaagcgagtctctgctgactttcacggtagccgattcctccgccgctttagtcctgcattatcatttgtccgatgagctttccacagagaaggaattatggttcttcccgaatacggatacccagttcaatcatattgaccatgaccgtagtggaacggatatggcaggatatccgatgaaaggagtggagataccttcggccgagcttggtaaccggggcgtattattcggaggcttgggttggtatacccgtctggaattcccgtatttgaataatctgatgcaacaaggcacgcaagtggagattgagagcgctttacttaagatttatcccgagcaaggcacttattcggattacaataccttgccggacagcctctacctatatatcgccgatgagaataatgtggtgacggatgccgtgaccgattatctcggttccgaggttcaacgaggtacgctatcggaagacaatacgtttaacgagaacacctattattatttcgacgtgactcaattcatgcaagaggagctaggtgcctttggcatgtataagcataatcttcagttggtttttaatagtgatgattacaccggcacgttcaagaacttgacgtttaacgatcagggaggacgtaacccggtcaccctacaactcatttataaggtctatgaaagttactagataccttctttacccttgcctcttgatggcggcaagcgcatccgcgcagaatacgatgacttcctcgccttactcgatgtttggactgggtgagatggcttccggtttatatggtcaaaatacctcgatggcgggtgtcactgtcggcatgcgggaagggatgctgatgaatatagagaatcctgccggattgacagcgttggatagttgtaagttgttcgctgaggcatctgccttcgtgaagaatgaacgataccgctcagacgggagctctagcagcgcattcaccgggaatttctccgctttctcattgggagggcgtatcatgcgacggtggtatatgtccgtcggggtaactccttatagtttcgttgggtattattttaagtcctcgcaagagttggaaggatctcccggaacctttgtaaccagtacgttttcggggacaggcgggctttccaaggctttcctttcccagggatttttattgaccaagcatctatcagtcggtatgaatcttaattttatcttcggaaatatgacactgaatgagatacaaagtgcgatgacagtgtcaagggagatgtccggccgctctttttacgccgatttcggtttacaatatcatcgtccgatcgcccgggaaacctttctaacggtcggcgccatttacggttataagcaacggatctcattgaaaaatacggtgacggtgacgggaagcaacacggaaaccccctataaccagaaaagggtgacacaatatctacctcaatatataggcatcggtagctcattggcgcataaaaaatggacgtatgcgttggactatctattccggcaatacggggtattgaactcgagcgatagccgggtaaagttccgggattcgcatgagctacgcttgggcgtatgctatttcccgaatggatttagctccagcagttattggaaacggatgtcttataaagcgggtgtttctgtttccacgccttacctgcggttgaaaggacaatccggcggggcgtatcgggtaagcgttggcttgggattacccgtcctgaatggccgtatcaatacggcgttttattacgatcgtctccaattgcaagggaatgcgttgcgaagagatatcatgggctttacggtgacctatacattaagcgagaagttctaccaagtgaagctttagttttctgcctatgaaactaaagtttcttcactaggaaacaaaagttttgtcacggagaaacaaaagtttcttccgcatgaaactcttggttactcttggagagccagattattcatcaaggcgggcaggtacgaatcgctgatagggatcagttcctccccgatacgtatccgcttgcgctcgatataattaatgtgggagagggatacgatgtaagaacgatgtacccggcaaaaacgattcctgtccagaaactcctcgaaccgcttcaagctgacttgcgtgagcaggggcttgccattgatacggtgtacctttacataatcgccgtatccctcgaggaaaaggatctcttcccggcgaaggcgaatgatcttgctgccctcccggacgaagatggggcgttctgtttgctccttgctcagcacttggtggacatcggccaaagccttgtccagtttctcgagatatcccatgagcgtgttcagggtcgaggcgtctccgtcgaaagtgatacatttcagcatagtgtttttacctttatttgttgtaccgcgaaataacaggaaagttcggtaaagaaaggttaagcgccgattagtggtataatcgggtcggtgaatcgccttacgggagggggtgaaaagacattattcctcttccctcagaatccatttcttgaagatcggggtcttggtcttgctgatgatgatacgttcgggaaccggcaaggtgaggttgacggacaggcggctcccgaaccaaagatctatatccttgatggcgttgcgtgaaatgatgaattgacggttggcccggaagaaaagcctctcgtccagttgctctcccaacgcgtcgagggtacggtctacgggatgttgcttcccgtcggaggtataggcggtaaccttctcgttggccgtatagaaataaaggatctcctcaaccgccaacggatagaatttatcggccagcatgatcaacaggctcttgatcgtgtggcgactctggatcgtacggttcgtttgccggatatgcgccagcctttcctcggtatcgaacagccgtaatttattcaaggccctttccagcgaggccagcgtgacaggcttcagtagataatcgatactgcttacttgaaaagcctgtaacgcatactcatcgtaggcggtcgtgaagactactggggcatctatctccacctgctcgaatatcttgaacgccgatccgtccgctaaatggatatccatgaagatgatatccggatgaggcgatgtccggaagaaatccacgctctcctcgatactctccaactcggcgatcacttcgatctgagtaaccgtattttgcgccagaatcgcctttaggctattaacggcggtagtctcatcttctataataactgctttcatgagtgaatgggtttattaagtaaaggaagcgtgaccttgaaatattccttgcggttggagatctggatgtcctttccggtaagcatccggtagcgcccccataggttcttcaatccgataccgctacctttgctatcttccgacttaggatgtattttattggatatgattagtttgtcctcatgggtggtatagatatcgatctgtagcgggtattgcttgctgataacgttgtgctttacggcgttctcgatcaaggggagtacgctcaatatcggcagataccaaagcaagtaaggggtatccgcttggatggagaagaatagctttccctcgtagcgcacgctcagcagataggtgtacgcttttacgaattgaagttcttccgccagcgtaaccagctctttcttgttgctttgcaagatataccggaagacgttggatagctcatccagataagccagcgtctgttgtttctctccgctctgtatcaaggcgttcaatccatttaaggagttgaaaaagaaatgtgggttgatttgtcccatcaaggcgttataggaattctgtaacttctcggtcttcaattgctcatattccagtttcatttgctgcttgctgcccagcagccggatcagtatggagcttagcatgaccgtgaggaagacgaaaagatgctccgtcatgaaagagttagggaccgtgaaaggattgggcggtaccggtatgtcccgatgctcggcaggcctgatggtttgcgtagccatcctgtcccggttgatgcggatcatgatatcccgggtagctggctgaggtccgtcttctcccagccattctacaacaatggccgtgtacaaaaccggcgacagatgaaacatgccgtaggcgatgctgatacaagttacgcaaaccaccaatacccttttatactctttcctgcggaaaagcttgtccccgaacttatacatcaagctgttgacaataaataagatgaaggagaacacgaagaaccagattagcaaataatacatggtgcgatccggaggctggatacccatgttcgggtttccggtctcgaactcatatttacgcatcagaagggcgaagttcacgaaaatactaagcaagacggatatcgtgaagccgatcaataagtcgtttctttttaattgtaacatagataaaccctttgtctgcttacaaagatagggcttccttatccgagcgggaaaaggaatcgacgaaacggataaaaatatcggtgaatcgcccgggcttccgaaaataatgtacctttgctggaaattaggatctctgttgctatgacgaaatggtttgtctacatatttctggccggtgtctgcctgttgctttcctgtggcggtaaatccgtacgggagaaatttgcggaagcggaccggttggtaaacgagaataacttagatagtgccgcttggctgctggaggagcaaataacgctttccgctctttcggatagcgataaggcagagtatggacggaggctcgcttggcttcatctcttgcaggggcgcagcttggtgaacgactcgctcatcgactactccgtggattattataaggagcatgcctcggagcctttactttccgcttatttcgtaaaggctatttatatgggtgattcccggaaggggttggaacaaagacgtgctttgtaccgagaggcgatagattccgcttattcccgttcggattcgacctaccttgtacgtttttatgaccgattgacttccttgagctttggtgaggggttgtatcgggaaacgatcgcagactcgaaggaatgggaagcctcgccaaaagctggatttaaggagatggcctattatatggccgggttgagttatagccgcttgcgaatgagggactcggcggattattatcttcgtttggctgcggactcggccttggctaagaatatcgaatggtatgcccatcattttgcccgtaattatgcggatttcttgtatgattttaatcccaaggcttctatcagctatttacgtttgttggaagaacgatatccggagcgagagaccccgggatcctatgttatgccttggatcaatctaggggaattggattctgcccggaagtatatcgagaagaatacgttaggcttggaacttagtcacagtgatgatatagcctcgcatgcgctgaattatgcctatcaatttatattgggcgtaaaggaaaataaaccggtggatatttcccggttagggcaatattgcgattctttgtataccgtgaaatcccaaacggagaaggctgagcgggaacgattggtcgatcaaaatcgtttacgccgagaaaatcttcgcttggagatgagccggcagcgtacgttctctatcttggtgatcgtttccttgctttccatattggtagctggtggagtttccttatatatccgtaaccgaaggaatcgtttgattgatatggaggagcgtttggaagccttgcgtcagctcttgaacgagtccaagcaatccgtagcggaggagaaacccgatagtgcctttttccgtaaggtcttgttgcagcaattgggtgttatccgcttgatggcgactactcccacgcaacaaaataaggaattgctccagcaaatgactcgtatcacgaacgaggatgtcccggtagatacgcttttggtatgggatgacctgtatccgattatcgacgcggtctatgataatttccatacgcatctggtccgattgtctgacgggcgtttgctggaaaaagagatccagctttgttgcttgctatgcgccggcttctctaccaaggaaatcagtgtagtcacccaacaaagcgtccgtacgatctatcagcgcaagacggacatccgccataagctgggtatggacgagaaagaggatattatcggctatataagcgctcaaacggccaatataaacttttctctctaagtagctcggcaatgctctgtaaatcagcgtatgctgaaaaggcttcgcactttagtttctagcctgtataaatcgattatagcggtttccctccttacatttgtctcgaatcaaatttgaattttatgagaagacaagtattatttgtgggattgatttgcgttgcctttttggtaaacgcgcaagaggagaaaacgatcgatttggatgaggttaccattcaagcctcttcgattataagaaagaaagaccgtcaacttatattcccctctaaagaccaagtgcggcgctcgatggatggcttggatttgacaaggcggatgtctttacctcgtctatgggtagatccgaatacgaaaagtatctctatggcgaatggaaacgttcagttgcgtataaatggcgtgttggcttcttccttggaagtcgcagccctctcgccggaggatatcaaacgggtggaatatcacgataatcccggcttgcgatatggggaaggagtcgatatcgtcttggattatataacgatcaagcggacttccggaggaaatctcggcgtggatttaagccatcaattaaacacgttttggatggcagattatatatatggtaagtataaccgaggacgttcggaattctctttatccagctttgcgaacggacaccggtataaagaggcatggcaagaccggacggaaatctttcataccccagatggtaccttccagcgaacacaggaaggaatccccgggagggattatgagatgtattggactacgacggcgaattataactacacgaaggatgatgattatttcttgaacgctaagctgaatttttattattatgactatccgcataactatagcagtgcccttttaaggaatagcgagagcaagatgacgaccgatcttatcgataataataaatccttgaatacccgtccctcgctcgacttgtattatttccggaaattaccacgtaaacaatcattggctgtcaatgtcgtgggaacttattcgaataccgatagccgtcatacctaccgggaagaactggaaagtattcctttgacagatatttatacgaaagtagatggaaagcgctattcggtaatcggagagggtatctacgagaaagagctagagaccggtcgtatttccgccggtttgaaacatacgcaggcttatacggacaacgtatattccggttccggtgattatacgacccatatgacggaatctgaatcgtatatgtatgcgcaatacgtaggaacttggaagaagttggtttataacgtaggtttgggcgcctcccgtaattatctatcgcaagaaaactcgggctcttataatcggtggtatttccgcccgcaggtaacacttacttatactatcaatgaggtattatccgctcgttatcggtataccctgcgcaatgtaaacccatccttgtctgagttgagtaacgtggagcaatggattgattccttacaggttcgtagaggtaatccgggtctatcccctttcttatatcataacaacgccgtggaatttcatgtgaatacggcaaaggtcaaggccggctttactttctcttaccaataccagccccgcatagtcatggaagagaccctgtatgacgctagccggggactttttatccgtacctacgataaccaacggagtttccatcgttttacgccggaactgtatttgaattattcacccttcggcgattatctgcgcatgaatatctccggaggcttgaaccatttccaatcgaatggaaatagctattcgcatacatacacggatcccttctatgtgatctctttgaatagcgatgtgaagaactttaattttaacctgttgatttataagagaagctatagtttttcgggtgagaccagtcgtgaggccgatcgttttaataggttgggtatcggttataggatcgggaaggtccagttaagcgcttctttctctacccaatttacctcatccgcccgttaccggagtaagaaccattcagcgatcgctccctatgtgaccgatcagcgttttggtgatatttatccgggcttcgagattggattctcttaccacttagatttcggtcgcaaatacaaatccgtggatcgtaagttatataattcagataatgaatcgggtatattgaatagtcggaagtaagttacatctatattgtcgattacgtgttcgcggctttcagtatgcaatatatcataattgggtaggatatagttctctatcattcctacccgtttcatgcgtgcgaacacctcttgataaggctgccccaatttgcgtgcggttccttctatacaaaaggaagcgaacgctagctctatttctgtttgcgatagttcgatttgtttatccatttttccatgtcgcttaggtgaatttgcttcaaatgtacgtaaaaagtggctcatgcgataaaatccgtggatgaaattatctataaatgggaattccgtagaggtagtacttactttaccgatgaagtatatctcctgtggaacttgaagtatatctcttatagggaagggagtggtatctcgtgaaaatgacttttgatgaacccttgttttagagcatatcaaaattatctgtcagcgatatttattcatgaatcgtgggcgacttggatatatgatttctttcaatgcccattctaaggttcttataatgcccatcgtaagctcctttgaatgggcattgttagatgcttacgatgggcattgtaagaaacgataaacaaaaagccatccggcattccgctggatggcttttcgtatggcaatagaatcggagagattacactctcttttctttgattcttgctttcttaccggtaagggcacgcaagtagtacaatttagcacgacgtactttaccgactttgttaaccgtgatgctttcgataaacggagattcgatcgggaaaattctctctacacctacgttctcagacatcttacgaactgtgaaacgttttttgtcgccgtgaccggagatacggataacaacaccgcgatactgctggatacgctctttgttaccctctttgatacggtaagctaccgtgatcgtatcaccactcttgaatgaaggaagttccttcttcgtagcgaacgcttcttctgcaatcttaattaaatccattgtttatagctttttaattgtaatttataatgaaacgcaatttaacgggctacatttcccgacagagattacgtaaagcgggtgcaaagtaacgaaataaatatttgattcgcaatagatagatgcttttttgctcgctatttgattaaatcttttatgtctaccaaggattcaaaccattgacatccaccagcgattcccgttcctccttccacattgctgtagattcggacaggctcggccagacctacattcgtaagtccgcccatgataccttcattcttgatgttttgtaaagatagcagatattggtaatagggttcggacagggaatataaacgaatatggcgtttggtataatatttagtatcggacctaagttgttcttttacttgcaacgtgtattccttcccgtcgaacagctcgtcggaaaatacccgtccccgccaatttaccatcgaggagccgaaaacctcatccaagataccttgttgctgcgtgaatacgggatctacggagaagtccaacaggacaccaagatggtcgtcatctccccatatctgtagagaatagtaatttgatttacccggggtatcttggaaagtgatttgatagataagcacatcgttttcttctatgtaggagatattcccatctccatcgacaagggtaccgccgttgccggtagcttctttacggggaattatgcgcaggcctttgatttcggtcttggaaggaatcttatcttccgccgaggctgttccatattccggggtggaagctacaatctttacggtttgtccgggctgtggaaccgtattcgatatataaagcgtatctgttacccatccacctcgatcctctccgagccaacgagaagatttccaataggaatattctttccaaggcatctcctccttgaagatcccgtctatgtataattccaccttggcgtttcgaatcgttacgtccggcttgctctctgagtgaaaccatgtgcgggatatgctggccattacgactgtatctggcgagaaggccgagttgatcaccatttttggtgtagtacgatattcctctaggtcaaacttcctgtaacaggaggttaggagcatgctggataataagattgataaatagaatataggtttcatgttctttagaatttataagtatatgatatagacggaatgatcggtaagagcgataacgtctcgaaataatggctatagtttatccaagaccgcttatggatagttatcgggttcatctggcaataagcgttatatacgctgatattccagataccgagatggccgttctttttaggtcgataaatattaatccccagatctaagcggtggtaagcggggagacgtacgttattacgctccgtgaaatagtccaagcctccttccggtaagagcggagggacaggagtgaggcccaaatcctcgtaattctcgaatgccaccgtaacccggtttccggtcatgaaagtccagcttcctgttagttccaatttctcgttgatcttccagtttgcgacgatattcagcttatggcggttatcgtatttcgcggggaaacgtttgccattattaatctcgtcgaactgccggtcgctccacattagtccgtatccgatccatcctgttatacgccccgtctctttccgggcgataaactccgctccataggcccaccccttaccggcggccagtttctcctcccaaccgacgaacgagggtaagaagttgtaaccatctttataatccagtaggtgattcatccatttatgataaccttccaccgagaaggaatagttcttgtgcagattgtaataagcgccaacggatacttgatcactcaccaatggttttaatttcttgctgaccggcatccacatatcggtagggagactcatataactttcgctaatctgatgtacgtattgattcatccgggcgtatgaggccttaaggcttagatccctcgtgagcaggaagcgtacggataaacgagggtctaaggagacatatgtcttcttttgtatattgtatatgttcaggcgtaatccggcgttagcccggacaatgggagatatcgcccagtcatcttcggcgaaaacagccaactcattcgctgaaaggcgctcgtctccggtagttcgtttggtcggagacaaattctcggaggtcttttcctcgatatattccgggctgaaacgatggtaaagatagtcggtaccataacggatatgatgtgccaaggtaggaatatagtcgaagttcgcatggactccgaaatcattgataccgtttcgggttgaggtctcgataaaccgtgaagaataatctttgtcaccctcggttccgtagtattgtgaagtctcttgttttagtttggattgataatgggaataagccaaggtgacggtaccgaacatcttgttgttaaacacatacgaccagccggaagataatgcgatgttaccccagcgcatctttccaaagtccttgttctcgaaaggggttatatcatcacctacggagaactcagaacttcctccttttaggaaatcctgtccgaaatagaaattaacgtaagcttggctccggtcattgatatggtggttcacttttaggttcagatcggtaaaagcatagcgtgcgctgaatttctcccccttctttttctgaattttattgtagatcgccaaacccggtgcggataaggcatccagccaagagcgacggaaggaggcgttgaacgaagtccggtctttaatgatcggcccttcgaaatttaagttaccggaggtcaatcctagcatagcgctaccatggtactctttcatattgccatctttagtatgcacatccactacgctggaaagccttcccccatagcgggcggggaaagcggatttataaaaatccacatctttcaaagcctcggcgttgaaagcggagaaaagtcctccgagatgattgacctgatacagttggattccgtctatcatatacaggttctcgtctccattccccccacggacatacatcccggctaatccttccgttccggctgatacgccgggttgggtttgcagggctttgatcacatcagcctcaccgaataaggtcgggatggtcttgatcatcttccgggttattttaatcgttcccatctgaggggcttgtatcgggttttgtgtgtcattactaccggtaacgacaacttcggccaatgcctcaccgctttccagcagaatttccatcacggtatcccgttcgagcggttggaatgtatgtgagaaacgtccgtatccgatgtaggaagtctccagacggactaccccgaccggtaaggttagactgaagaaaccgtggttattggtagctgtgcccctttgtgtgcgagagtcataaacggaggccccgattagatattctgtagtcgctttatcccgtacgaatccgctgatggttactgagcgggggagtttcttcaagatgatgtgggtaccgtttatctgataagacagagggagcttttggaatagccgggtaaggcattccgatatggattggttatcagatttgaatgtaatccgggaaatacctttgagaatagaaggatcgtaggagaatgtcatgcctgtttgatgctctatttttttcatgatttcttggatcggttcttgtttagcctcgatactgagagtcggcgcctgtccccaagcgcttgattgaaagccgaagataatcaagattatgagtagtattagcttcatgaagtacttccttttttattacgagacaggaaagatagtaaaaacccctatcacaattcacgttactattgcgatattttcttatttttggagagtaataatgataatgttgtgatgagacagattggtatcttgcttttgtgttgtatttcccttttatcgagtggggcgcaaacagtcccgaacctttatcgtgcggtggatcaggaaaagatgaatcattgggttgattccgtgtttgacgctatgagttatgatgaacggatcgggcagttatttatggttatagcgaatcctaaatccgataaccggaatatgcaacggctcatgcgttacgtgaacgatatcaagatcgggggcatcttattccataaaggggatccggtgacgcaggcggaggtgaccaatcgtttgcaaaaggcttcccggattccgatgttggtctctttggatggggagtggggactttccatgcgattaagtggaaccacccgtttcccgaaaaacatgatgctaggcgctatcgaggacaatgccttgatcgaggaatatggaaaagaggtgggacggcagtgccgggaaatgggaattcatataaatttcgctccggatatggacgtgaatagcaatgtggataatcccgtgatcggcctgcgttcgtttggcgagaatccggaggctgtgtcggagaaaggtattgcttacgcaagaggattggaaaatacgggcatcttgtctgtctccaaacatttccccggacatggagatacttccgaggactcgcacgagacattacccgttgtgcgccataaccgggcccgcttggatagcgtggaacttcttccttttaaacgttatatatatgatgggttcggcgggataatgacgggacatctttacgttccagctttggataaaagtcataagccggcttctttctccaaggcggtagtgacggatctattacagaaagaactcggttttcaaggtctgtgctttacggatgctttagcgatgaaaggggcttccacaaagaaaacggataatccttcggtgaaggctttgcttgcggggaatgatatcttgctcgctccggccgctccaatcaatgattttaaggccgtgaaagaggctattgaagaaggggtattggatctggaagcgatcgaggccaagtgcttgaaaatattaaggtacaaatatatcgctggattgaatgcctataagccggtcgaaacaaaaggcttatcgaaacgtttgaactctccgcatgcggcatggatggcggcgaagttgaattcggaggctattaccgttttgaagaatgaggatacgatcttacctcttaaacagttgaataagaaaaagatcgcggcgctctcgattggagacggggttggtaatgaattccagaaaatgctgggcgaatatgattcgatcgcttgctttagcatcggacggcgttctacggctgcccaagtccagcaggtttataataaattgcaaaaatacgacgtgatcatttgtggcgtacatacgattcgcattcccgagagtttagcgttgaggcagttggccgcgaagaaagagttggtctatgctttctttaccttgccatatgcttgtaaggaatataagaagtcgatcgagaaggcgaaggcggtcgtgttggcttacgagggcactcccttagcgcaggaatatgcggcccaagtgatattcggtggtattgcggcgaaagggaaacttccggtttcgattccgggattgtattatgcgggtaccggtgtttttacggagaagactcgtttggggtatcaccagccggaagaggtaggagcgaacccggaccgtttggatgtaattgagtcgatcgttaaagagggattggatgagaaggcttatcccggatgccaagtgttggttgcgaaggacggcatgattatctataataaatcgtttggttattttgattacgaaagtaggcagccggtcacggaggcgtcagtttatgacttggcttcggcatcgaaggcggcggggactttattggcagtcatgaaagcgtatgatgagaagaaattcaccttgaacaataagatctccgattttataccggagttgaaagagtctaataaaaaggatttatcgataaaagagttactatatcatcaatcgggagtgactccaactattaatttctatctggatgctattgataaggatagttataaaggcagtttatatagttcggcgaagaacgccacgcacccggttcgttttgacgctaaaacgtatgtccggaatgattttaaatatcttccggatatagtatcagatacacggaaacccggatttacgactgaggtagcccgtaatttctatgtgagtgattcctttaaagatacgatccttcaagatatcaagaaatcccgtttgggtacgagaggtaggtacgtatatagttgcgtgaatttcattatgctgaaaatgatggtggaaaatctgatgaaatctccgatggaccagcttcttcgggatgatttctacagcgggttaggggcttggcataccacttataatccgttgaagcgaatggataccttgcaaattgtacctacggaacaagatggatttgtccgccgccaattgcttcgcggatatgtacatgatgaggcagccgcttttcaagggggtgtttctggaaacgccggattattttcgaatgcgaatgatttggcgaaggtgctccaattgatgctaaaccaagggacttatggcggcgagcgctatctttctttggaaaccagccgtttgtttacacaaagcaagagcccgacttgccgtagagggttaggctttgataagccggtgattggtaatccgaaagcctcgccttgtggggctttggctcccgcctcagtctatggacatacaggatttacgggtacttgtttttgggtagatccggataaccagcttatttatatatttttgagtaaccgggtgaatcctagccgggcaaataataaactgggatcgcttgatatacgtactcgcatacaggatgcgatctataaggcgattgataggaaaagccaaaaagattcgtaattttgtgacagttttaacagataggtattaattaaaaagcaggtatatgttatacggacacggtgatgatttttataacgcaaagaacgaggtaaagataaactttagctcgaatgtgtggcacggagctaatttagataaactgaaggaacatttgatcgagcattttgataagctgactcgttatccggagccggacgccgctactttgaaaagattgttggcccgccggtatgagatcaaggaagagaatattgtagtgacgaatggctcgatcacggctttttatttgttagcgcaagcttggcgaggtgcgaaatccatgatcgctattccttctttctctgaatatgaggacgcttgccgtttgcatgagcatgagatctctttcttcccgacatcggacgatttatcagagttatccttggagggacaggatttctgttggatttgtaatccgaataatccggatggaaagctgatccaccgtacggagcttctccgtttgatctcggcgaatccgcagactaccttcattattgatcaggcatacgtggcttttacgacggaagacatgctaaagccgagtgacgtgaaaacgcataagaacttaatccttgtccagtctatctcgaaggcttataatatccccggcttgcgtatcggttatctggtcgcttctccggagatcgcggagaaagtgaacaagtatatcataccttggtcggtaaatgctatcgctatcgaggcaagtaaatatatcttgatccatccggcgcaatttacgttgccgatccgtaaatggcagcgtgagactgcggattttatttatcaattaagtaaattggatggcttggaggtaattccgacctctacgactttcttccttgtccgtttgaagaagggcacggccgctgatttaaagcaattccttttagataattacggaatcttgatccgtgacgcttcgaatttccggggcttggatgagacttatctacggctctctacccagaagtctgatgagaaccagatcttacttgaaggggtgaaggtttggttggagcaacaataaattgaggacgagaaacttccggaggtatgtgggtatttccggaagtttttgttaaaatagccaaccaatgaacaggggcaagtagtctttcaactctgtctttaatatttcaatcgccttatttttatatctttctactgtccgtatggatatttgcatatcctccgcgatctcgccgtaactcttattctcaaagcgattcttctcgaatacatatcgatagttttcaggtaatttagcaagtgcctctcgaagtagggtttgtaattcttcccaagtataaagctcctcgccactttccgcatagatagggatttgctcttgagagaactggtctacatattcttcgtgattgcgttgcagatagttgagactgtggttcttggtagctgtgatgagataattgcgcgcggaagttcttattacgatgcgtttacgattttcccagatggaggaaaaaacttcctgtacgatatcttctctcgtttcccggtcagagataaaacgtttggtatatatgcaaagagccggataatataactcaaataaacgttggaaggagagcttattatcctcggtcgtgatttgccgtaaaaggaaatcgatatcagtcattgttggatttctttccataatgggacaaatgtatatatttttagaatatattcccctttgtttcacaagctaaaatccttgctttttgtgcaattggtgaggagggcccacacatatatacgtgttgggcaatacctgcttaggtgatttccttgctttattgtggggtacaagaggaagaaaaatataaaaaaagtcgttttgctgtcgtgtttttgttttgactgtgtctatatagaaaaagacaatcatatatgcgagaaagcggagacgaaaaaagtacattacggcagattgagaagattaaagctctgtctgaggatatgctagaataccaagcgatagatgtgcataaggcttggcaaagcatggaacgtcgtgctaagcggaaagcctctatgaggatgttttcgttgttttttacccgtgccgcagctattcttgtagtaccgttgctcatatcctcgttatttttttcttatttatattataccacaggtaggaatgttaagacgggggcatctgtggtttttgcggagattagttccatgcctggtacaattacccgtttggtgttacctgatcaatctgttgtttggttgaatgccggcagccgcttggtttatccatcggtctttgatgagaaagaacgtaaagttcagctctttggtgagggctattttgaagttgaagccgatccggaacatccttttagtgtgtctacctctgagggattgcgggtaatagcgtatggaacgaagttcaatgtgaatgcctatgacgatgaaccttttatcgaggctgtgctggaaaaaggaaagatcgatgttatccggaacgatgaacggatccgcttggaaccgaacaaacaggtcgtgcttaataaggaaagcggtgtgttccgtgtttctgctgtcaatttggatgagaagatggattggagaaaggggcggatggtatttcgaaatactcctttagagaaggtactaaagcgactggaaaaacgatataatgtggagatcgtactgcataagaactcgaatgcggagtataaataccgtgcgactttcacaaatgagaccttggagcaaatattggattatctaaaacagactgcccctattgaatggtctgcccgacaactttcctctcattcggattccacgtttgtccggcagaggatagatgtttatcaacgataaaaaatcatttcaaaataaattttgtgtaatcactaaatctacatgcttatgagtgcatttcatttacgtaagaggaatcttactcggtatttacctcaatcgaatcgtatcttaaatcttggtacggcatttacattcttgactgccttccagttatatgcaggtacctcttattcacagacaacaacactttccttgtcgttgaaaaacgctacgttggagcaagcgatcgatcggatagaggaggaaacgggttattcattcttgtatgcggatcatgttttggatgtgagccgtgttgttaatttagaggccaataataaggatattaatttggttttatcccgggtcttcgataacatgaatgtcgattacaagattgtggataagcagattatcttatcgcataaattagaatctattcctttggcgcagcaacaaggacatacggtacaaggagtcgtattggattcgaaccaagaaccggtaattggcgcaaatgtattggtgaaaggaacgactgttggtacgattacagatattgatgggcgtttcacgctggaagttccggataatgctgtattggttgtttcttatattggttatttatcaaaggaattagtacccggatcaaagacagatttgactatttcgttgaaagaggactcacaaaacttggatgaggttgtggtcgtaggttatggtgtatcccgtaaaaaagatcttacaggcgcggtttcggtcttgaagatcgatgatttgaaagatacaccggtttctagcgtagaccaaatgatgcagggcaagctctcaggagtgaacgtgatgccggataatatgccgggtggaggagttgcggtgcgtattcgcggtttcagtacgatccgtaacaatgatccgctttatatcattgatggtattcctgtggatggtggtatcaatttcttgaatccaaacgatatcgaatctatgcaggtgttgaaggatgcttcctctgcctctatctatggagctcgtgccgctaatggtgtcgttatcatcaatacaaaaagaggaaaagagggtgaatttaatgtcaatttagatgcttactttggtgtacaaaaagcggcgaaacaattgaggatgttgaatgcgcaacagtttggcgatatgttgtggcaggcaatgaaaaatgatggaaaaactccttcgcatgatatctacggaaatggtgatcaggcagttgttcctgaatatttggatagtgatcatttaatcccttctgatgacgtggattgggtcgatgagattttacgtgcggccgtagtacagtcttataatctctcttttacgaaagcggataaaaaatctaatcaattattctcgttgggatactatgatcagcagggattggttaagtttagcgattttaagcgtgtgagtggtcgttttaattccgagtataaattgtttgatgatcatttccgtataggagaaaatatctctctttctcattcttggggaactagtgtctctaacaatgccgccttgggaggaactttgtatgaggcttataaattccagtctatcacgcccgtgaaaaatctggaagatgagtatgccggaaatgtattctcggatattccgaatcctatgggtaaattgtataggaacaaggataatcaagataagaagagccgtttggtaggtaatttgtatgccgagttgcatttgttcgatgggcttatgtttaagacctcttttggtgttgattacaataatctgtatagacgttctttcagtccaaaatatgatgagttgaatgcctcggagaaattaagtagtttatccaaccgaaatgcttggaattttaactgggtattcacgaataccttgacttataataagacatttggcgaccatacgatcaatgccttattaggtatggagtctttgagaaatagatatgagtattttacagcttcaagagacggttttccgtcagacgatcctaacttccgttttttagatgcgggagatgtaggaacccagaagaactcgggtgctgctacggagtatagtatggtctcttatttcggtaagctcgattataattatcatgatcggtatttggtggcgtttactttgcgtcgggatggttcatctcgtttaggtaataacaaatggggtaatttccctgcggcatcagttggatggcgcattagtaatgagccgttttttgatgttgaggcaattagtaatttgaaagtacgcgttggttggggacagaatggaaactcggatgttccgtcgtatgcgacgattgactcatataagagtaattctacgaactcgaattacccgattgatggaaatcaaagtggtgtagatctaggattggtgcagactcgaaacggaaacgttaatttgaaatgggagacaaccacacaaacgaatgtcggtgtggatttgggttttttgaatggtgacttgaatttgactttggactattttaataaagataccaaggacttattgtggcgtagagccttacctgcctcgatcgggggaacaaatatgactgtttgggataatgtaggtaagatgaacaacaaaggttttgagatggagataaattatcaaaagcaaatcaatcaggattttggtttctctgtcgcatataacttctctgttatcaagaataaaatgaccgaactgaatggggtggattatataggtctttccagtagtgaacttcacggacgtaatttcgatcaagagacttctcgttcagcggtaggacaaccgatcggatccttcttcgtgtatgaggctgatggtctgttccaaagcgatgcggagatccaaaactataagaatgatagaggtgagttattacaaccgaatgcgaaaccgggtgatattcgcttcaaggatttgaatggagatggcgttatcaatagtgatgaccgcgatttcaagggaaatccgttgcctgattgtagcatggggttgacgttgggtttcaattataaaaactttgatgttagtgccttcttccaaggtgtatttggtaatgaggtctataatttgacgaattatttgggtgagttttataaccaggctcaatataataaaaattctacgatcttggatgcttggcgtccggataatacggatacggatatacctcgtgtcacattggatgatccgaataataatattcgtccttctacctattatatccataatgcctcttttgtctgtttaaagaacttaaaggtggggtatacactaccggataaagtagcatctaagttgaagttgaaacgtacgtatatttatttgcaaggacagaacttgtttaccataacgggatatgaaggtattgatccggaggttggtttgcagagttattcttctgagaatcgtaatttggatatgggggtggatcgtggagtgtatccattaccaagaacatttactttaggggttaacgttagtttttaacataaaaagagatatatacaatgaaaaagatattttattttgcggcatcagcgttgatgatgtgttcttgtgcggactcattcctttctgaggagcctgtgggtgagttcttgcccggacaggtagagagtgaggaaaatatagagggtatcgtgaccggtgcatatgctgtgttggatgggtattatgcctctgatgcgattaattccggttgctcaaactggcagttcggggatgttgtctctgacgatgcgtataaaggtggcggcggtaccggtgaccagaaccaaatccatttgatggagatctttaatgcgaatcccacagggattgactttgaagctcgatgggctgctctttatgagggaataaaacgttgtaaccaagcgattcgtttattgaatggtagtgaggttaaaaacaaggaacagcgtttagctgagatgcgctttttgagggggcattattatttcaacttaaaaatcatttataatcagattccttggatcgatgaaacgttggtggatccaaatgaatacaataagaaatcgaatatcgagttttcatccgatcaattgtgggagaagattttagaagagttctctgctgcttataaagtattgccggagagccaagcggattatggccggcctactaaaatggcagctagagcttatatggcaaaggtttatttatatcagtccaagtggaaagaatgtttggaagcttgtgatgaggtgattcaatctggaaaatatgagctattccctgatttccggaatgtgttcttgcctgaaaatgataattgctcggagattatctttgcgatccagctgtccattaatgatggttctcccaataatgagaacggaagttatggcgatcgcttgttgcctccgggaggtccttatcctgtatatggctttttgcggccgactcaaaatttggtaaatgcttataaaacggatgttaaaggcttgccttataatgatggtaaagatgtgtcagagaatgactatgtagatgttcgtttggatcatacattagctagaccaaatataccgtttatggatgtacaattgtatgattggactcctagagaggctagtgtgtatggcccgtatagcccgaagaagcgtttggtttcattgaattctacttattattcgccgatatggccttatgtgaatgctttgaatttctatgtgattcgttatgcggatttgttattgtggagagctgaggctgctattgagacaggtgatttagagactgggcgtaagtatatcaatatgattagagagcgtgcgaaaaatactcagcatgtcaagacaatggatcaatcacaagatgctgctaattataaggtaggggtttatgatgagccttttaaatcaaaaaatgaagccgtgcaagcgttacgtatggagagacgtttggagatggcgcatgagggaattcgtttctttgatttggtgcgttggggtgtcgcggatgaagttatcaacgcttatatcgccaaagagaaagtgttccgttcccacttgcaaaatgctcatttcgtaaaaggtaagcatgagtatttcccgatacctcagtctatgattgatatttgtggtacggaagtaatgaaacagaatccgggttattgataaattaaatgaaagaaaaggcggtgtgtcaaatagtttaatatccatttgatgcaccgctttttcacgatgtaataaaaaatatgaagcagctaggagttattttatatctattgtgtttgactacctgttatgagttatgggcaacccctcataatgtcgcttatcaagctaaagtttcctgttcgtctgccttgagccaagagcaggaaggtaagtatgtgatagatcaggtgattcgtatttccggaaagggagaatgggtagccaagacaaaattggatgcgcgtggtcgggtgtatccgtatccttggatacaattagattgggatcatgcgatttatacgaataaggttattttatacgatcgggtggatgagcgaagccattgtgctgcgggtaccttgttctttagtgacggtagttcggtaacggttaatttgattcccaatgatggagcgccaagggtggttgaatttgatactcggaagacggaatggattcgttttcaaatgacggatggagaaggacaagatttagggctgtctgagatagaggtgtatcctgctcctgagtcttatccggattatatctcttgggtgaatccttatgtcgagaccgctaaaggtcgatattttttctttgtgaccggaagtttgcctttcggtatgataagttccgctccattaacccgcaatatcaatcaaggaggaggaggttataattataattctactaaggttttaggcttccctcaaattcataattggatgatttcaggattgtctttgatgccggtgaaagatgaggtagatgtttgcagaggagataaggtttggcgttcttctttttctcatgatgatgagattgtccaacctggttatcaccgtttgttcttggatacttataaaatatgggtagaacagacggttacggatagggtaggactttatcgttttacgtatacgcaagatggtttggcgaaggtcttggtaaatctgggaggtcatatagctacttctactttgttgaacgctcatgtgacaaaggtgaatgatacagagatctccggatattttgatacggctggtcgtgtatggggaggtgtcgatgtggctaaagtttattttgttgttcaatttgataaacctatggatgctttgaacggttgggttggagatagaaaggaaacggatatcaatagtttgataggttctccagaattaattaccgtgcctaagtcttcttttaaacaatctccttcttctggcgtagaagcttgttttggatcttttaaggctggtgatgagctgttgttgaagaccgctatctcttatgtgagtgaggaaaatgcccgtgagaatatagagcgggaatgtaaacattgggattttgatcaagttaagagtgcgtccgagcgtatttggaatgagtggttgggaaaaattgatgtgcaaggtggttcttttcagcaaaagaccaagttttataccgatttgtggcacgtattgttggggcgtcataagatagatgatagcaatggcgagtatccggattatttgtccggaggagaacgtattggaaaacaaacaaggatacatacgattgctcctaaattccaagtacggactttgcctaaagataaaacaggaaaatcaaggtttcatatgtataattcagatgctatatggttgacacagtggaatttaaacacgttgtggggactggcgtatccttctgttttagacgagttttccgcttcttttatcgaatatgacaagaatggaggtctattacctcgtgggccgtccatagggtcttatacttatattatgacgggctgtccggctacctccttgattacttccgcttatcagcggggggtgtttcataaatggttgcccaaggagggatatgcggctatgaaaaggaatcatgagaaaggtggtatgcttgcctttgatatggataaagagttggagttctatattaaacatggatattgcccagaagaggctggcttgactattcaatgggcctttgaggattgggctttgggagaaatggcgaaagctatgggaaaactcaaggattataattattatagaaatcgttccttgggctggcctgcgtcttggcatccggatttgaggttgatgatgcctagaaaagaaacaggagagtgggtccatttggatcctttgtccgagcgtgggtttgtacaagccaatgcttggcaggctacttttggattatctcatgacattgaaacattggctcgtttgatgggaggtaatgacagcttagctactcaattgaattatgtgtttgagatgtcgaaaaatgcaagattcctgtctagttatgttagttatgccactcaacctggttgctcgaatgcgcacgttttctcacatgtaggaaagccttggctgactcaatattgggtgcgtcaggtcgctaaacagacctatggtgatattacgccagagcgaggctacggcgaaaatgatgaagatcaaggacagatggctggaataagtgcactgatggctatgggattattcagtttggatggaggctctgcctataatccgatgtatgatattacaagccctgttttcaatgagattacgattcgattggattctcggtattataaagggaacgagtttaagattaaagtacatgataactccccagagaattgttatatccagaaagcttctttgaacggagagatgtatcataaatatcaattgccgcataccgtatttgagcaaggtggccttttggaattatggcttggcgataaaccaaacaaggaatggggaactcaataacgatttgggcatatctctcaatttgtgtgatgattcaaaaaaaggatgtgcgtaacaatgaggcacatcctttttcatttccttttaaatctaagtagcgtgtattattctactcgtttgttgattacgatatgaccaaaatagccaaggagaaccaatcccagacctgtaagtagaatactatttgtcatacctccggtgaaaaacggtacagccaaaactgccgcaccaataatgagtacgatcactcctagatttttaattaactcattcatggttatagatattttataattattttcttttctaccgcaaataaagcaataataacccgatcgtgaaaatattttcggagaaaaataatgaaacgattgaaattagcttctatatttgtgttataatatagttacgtatgggaagaatactttacatagtttatttgtggctgttttttgtacctgtatttctggtactgactatacttacggctgtgacggttatcatcggttgtctattggggggagagaaaatcttcgcttattatccgggtatgatctggtctcgattgacttgctatctggcgctttgtccggtgacggtaaaagggcgtgagcatatagaccggaaacaatcgtatgttttcgtagctaatcatcaaggcgcgtttgatattttcttgatatatggtttcttaggcgttcccattaagtgggtgatgaaggcgggtatcgctaagattccgtttgtcggggctgcttgccgtgccgccggttttatctttgtcgataattctacgccgaaggccgccgctcgtagtgttttggaggcggagcgttgtcttcgaaacggggcttccgtggttgtttttccggaaggttcgcgtacgtatgacgggaaaatgatccgtttcaagaaaggggcttatcaaatggctctggatcagcatttgcctattattccgatcaccttaaacgggccgtttgatgtcttgccgatcgggtcgttgaatgtccatcgtcatcggatggagatggtgatccatccggcggtttctaccgagaatatagacacttcccacaaaggaatgcaagcgttcgctgatcagactcaagaaatcatagcatctgccttgtgggaagaatataaataatttaggttattatttccagcttttcaagatgccacgtttcgctactttcaggctgaatccgaagttatcgccgaacatggaaccggcatcagctgccaaagaccctgtaaattcccatcccgataaacggggatgttgataagagatatctaaaagtccggaagctcctcttttcttgctaaggaaaggggtggcatgtctaccccaactattcatcacggtgactaatacccgataagatacttgtgaggagatagagccttccgcaccgaaatgccagtcacgaacacggttgttcttgaatcctaatgaaccgttctcgttatactccggacttgggatcagaggagaacctatcgcccggttaaaataagaggctccggtagtgtattctccgttgttataataatcatcaccaccgccacctacgccgggatgtaggtcgtgatcaaaatcgatgaagtggaactgtccgctttggtctcttgtaaccagatactccacgaccaccttacgcaaccacgggaattttggtaaatccaattgccctccccataatccgtcggtattgtttacgaatatcataccggatttatcctcgaagaaatgttggtaataggcggatacttgccagttaggttgtgtaaaagccaatttgaaatcgtaagagccataatgattacccagtacgttgatttgatcggagactgttgcgtcgccacccccttcgctgccgcaaataacccggataaggtccttgatggattgaggctgctttccgatcttaggattggttgaggttcctccccattgtgcccaatgctgtactccgattacaccggataacgggaagtcattgcgtgtatccttaatctgtacaaataatgatttatgatgccataaaacgttatctacataagtctgcttattgtttgtgaagttagccagataatccttgtcgaaagaacgaccgacggcaaagtctcctttgacttgcatccagcctttcgttaaaggaacgacggtaaattccggaatgctgatgttcacttccggtatcgggcgggcattggcggattgcacgatatcgcccgagctaagccaacgatcccaaagtgaattatagcgttccttgcttcctacactcaatagcaagcatttgtaacctaactcggcatatatttgttggataaagaaattgcgatgacgaggaactgcggccactacgtctaatccggctccccagcgaaaacctttgccaaaagtttgattatggaatactcccgcattcaaatatccgttattcgcttccaaaggaacaattccgtatcgattgctaaccatccagaaaggggtattgtcgccactagctaccgatccgaatatttcggccttgtaggtagtcgcttccggagttgtctcttcttcttgagcgaaactagccgttgccatccccagacaagtcagacctataaaaattgatcgcactgatttcatgtatatataaatgttttgtctgggcgcaaaggtaaggatttatatgtttggtgcaaccattattgtttctttaaccactcgaatatagtttgataggcatcgttccgatagggcttttgagataggatcagatcgtggatgccgtttggaatggtatctctcgtgactttgtctcctagtttctccccgtatttttgaatgtcttgaacatccaagactatgtcggaggtcatgtattcctcatgccatgtctctgtttccggaaaagatttgttggaagacatcactagtatcggacaatccagttttaaccctttttgtaccgtctgttgcgcttcttgtatggctttgatccatccggcttttttcggatgcccgaatatcattttccagttcgtatcaaattcccattctcctttatactgcttaagcaggctataagcgtaattcggatcacccaaaccttgtacggtaagattcggaaatagcctcccgacaaacgcaacggttggcagtacgactttctccattaaccatccgaaattccaatctagaaaagggctgttcagaataagcccgtctaccggtaactctccttttttactattcaaataataaggtgtgatcaatccgcctgtagaatgcgccattaataatatccgctcgttgccttcagaccggatggtggccaaagcggtatcgatatcagcgaaatactcttttaggctcttgcaaaagaacgggttttgattgggtaatatcgaacgtccgtatttccgcaagtccatcgcatagaaattatatccgtgagcgtttacgctatcccctaattgtttctggaaaaaatagtcattatagccatggatatacagcacggcctgttttacgctatccagttgaggtttcttgaccagtgtgcaaactaccttcccctcataatcatccggcatctggaaggtacggcgtaaataaccatctcccaatacatcgggtacgtattgggcatatacctcgcataaaatgaaacagaggaatataataagatttatttttcgagacataaatatattgtttctattttataactgtatttgcaaagatagggtttatcaatcaatggtaattaaccaagatcataaaataaaaaatgacagataagcatgaaaaacgataggataaacgtgaatattgcaacttatacgtaaaaagcactatttatggtaagccgttaattttttatcttaacaataaatattttactttgttggaaaatggaagcgtgtatggaaccggaaataacagtaataatcatagatgatgaccttggatcgatccagaaattgcaaaacgatctattggccttctcggaggtaaggatattagatacagcgacaacggcggaattaggcaagaggcatatccttaagtatcaaccggatttggtgtttttggatgtggaacttccggacatgtctggctttgatttgctggatgatatacgggatgatattcttccgaacttgagagtcgttttctatacggtatacgataaatatatattggatgccctacgtgcctctgcgtttgattatttgttaaaaccttatttaattgatgagttagcggcactcatcgaacgttttcatacgacagaacctgcggatgttgcctgcatggagagatccttgcggaaaatattgaatcgggatagtcgatttgcgatccaaaccgtttcgggtcttttgctagtccgttgtgaggagatattcctgtttcagttcttgggagatcagcgttgctggcagattgtcttgacttcccgtactactcataaactaaaaatgggcacgacagcgaaagatttgttgtctatcaataatacgtttgttcaaataagccaagattgcattgtgaacttgacttatttgatgttcatcgagaataagaccttacgatgcgagttctatccccccttccaagaggaggagaggatcgcctcgcatcgctattttaaacaactgagagaacggctggatattatttgatggttcctcttcttttctccctaattttatctgttttgcagggtgtaataggcttctgaagtgaataactaacggcttgggaagtgaataactaatcacttgagaagccttttgcaagcgattaagtatgttgtctaaataattcattttcaccgcataaggaatttacatttcaagtcgtaaattatttacttcagtaacggatagtgcctactaagatttgcttattttctgacatttacatacaagagagtcaatatattctagccatccaatccgcgaaaaagtagtcatataccctataaaagccatcttcctgtgttatcaaatcatttttcaacagaggtttgaccgcagattgtacagaactggctgagggtagcttgtattttttgataaatgctgatgacgtgagaccttctgctctgccctctttggcgatagcttgtaaaacaagtttttgtttgggagcaagattggcaagtagatccttgtaactactttcttgtgttagaatcacattcttgcgggctatttctatcttatccatactacaacgctcaccctcttcggtcaatgcgaaaagttcgttcattatcatttgcacaaaccaagtatagccatcgaacatccgataaacttcttctattacggatttgtcgataagctttcccctttgctcaaaaagccggttggcgaactccacatagatatgaatgggtattggcttaagtcctatactaatagcgctttgataaaaaggcttggaagaggaattaaacatattactcatcaaatggcgtttactgccggagaagataaacatagtctgcttgcattgttgaatcttggttcgcaacaacgcttctacatttttctcctcatagccgccaatttgttggaactcatcgatcgccacgatacatggtttatctgcggtctctagataagcgaagatctcatcaagtgttgtttgtggtgcttgaatgtctcctagcccaatatcaaaacaaggttctccggttaccatatccagtttaaaacccgcacgcaatgaggttatgatttgaaagaaccgttccgtccaaaccgttttctttggcttcaattcgtcatagatggcttttcctaatagatatacgaactctgttaatgaagtagtggcataaatatccacaaagaacgcatgataatttttttctatcgattcttgatgaaaaagatgttggatcaatccggtcttacccaaacggcgtggagaaatcaatgcgacattacgtccgttctcaatctgtttaatcaagaagcttgtctctccctcacggtcacaaaaatatttgtctgatacatatctacccacgacaaaaggattcatcattgcgattgtctccataatataaatgcattttattgcaaatataataattatatccataataaagaaaggaaacggtatgtttcacttgcacgtgtgggagtccgtattaaataatttgatatagagtgatttaattcgattatttatatatcttcgcattgtagaaaccgccgtttcggaaacagcggtttcggaactgtgtattattgccatgcgtaaagattaatctttagtatagaaagaatggaaaaacaatcatttatcgctctagtaaagcgttattatccttggatctgcagtatggagaaggctgcttttcgtatacatgatgatgtgaatcagaaatatgatcatgtgttgccttatggatttcatctgaaaatgacggtatcgtatgtctctcgctacggatatctggtagctgagaccgaggcggatatactgattttgtatgcctctgcttttctgcatgatacgatagaagatgcacggatgacctataatgatgtcgtgaaattcctgaaagagttcaaggggggaggctttgtcttgccggaaggcgtgagacagcacttggaagaccaagttccggaaatcgtatacgccttaacgaatgaaaaaggacgaaaccggggagaacgggcgaatgacctgtattatcaaggaatacggcagactaaattcgcttcttttataaaaatgtgtgatcggctggcgaatatccaatatacgatgatgtttgtttttgcgaaccggatgttggatgtttaccgtaaagagtatccggaatttatccgatcgatcagtgaaggtgcggttacacaggtgccggatgccatgaaggaggaagcggaacgtctgttaaatagcgaatcgtatattatatagtcttctcgaatgtctttttttcagaaatccatacggagcgatgaagatctgctcacctcattgaggcaggggagcgaggatgcgtttactgttatttatgagcggtatcataaattattgtatgtgttggcctataaatatttgaaaagtacatattcttcggaagatgccgtacagcaagtttttctgaaattgtgggaggcacgttccctactgatggtgaacgtgaatttaaggaactatctctatacaatgctaaagaatcacgtattaaatgagatccggaataataatagcgccgtagagaaaaattatgagatcgtacaatcagcgccggaatatgaggatgaactgcttataaagatagaggaacaagatatgatgtctcatttttaccaagcgatcgatcacttgccggagcagaaacgccaagtctgtctgtataagctgaaagggaatctttctaatcaagaaatcgccgataagatgaatatctcggtccccacggtaaaaacacattatgcgcaagcgataaaaatactgcgggcacatttcgagagactatttttatttcttttatatttgtggaactcatcctattgatggctttgcgtgtcaattgataaaagaaaatgaatatgaaaatacccgatctatcgatcatagagaaaacgctaaataatgaggctacttccgaggagtcttgtgaggttgttcgttggtttaagaccccggaaggacaggcatggcttgctgagcgtatcgatcaggatgagaaaacgattcatatgggggaggaagaggcatggatcgaccatccgataccctcagccgtaatgtatcagaatattatgcggcaactccgccgacaaaaaatacgccgttttatagcgtatgcggctgcggtctttataccgattgctttaattataggacttttcatacgcataaactcacaagtggatttgttggcggatggtgggtatgacgaggtgtacgtacctaatggggaacgcatgcagctgctttttcaagatggaagtaaggtccatttgaattcgggaagccgtattcgttatccgaaaaaattcggtctctccgaacgtaaggtttatttggaaggagaggcttggttcgaggtcgccaagaacaagaatcggccttttatcgtggatctttcttatatggatataaaagtgttgggtactacctttgatgtgaaagcctatccggaggaagaagctatattcgtcgctttagagacaggatctatcgagttgaaatcaagatccttcaaatcttatcaattacgcccgggagaaaaagcgatttataacaaggcttccggacgttgtgaggtactccgttcccacgatgtcaagatgtattcggcatggagacgtaatgtgctcgtatttaagagcgcccctttatcggacgtaatgaaaacattggctcgaacttatgatatatcctttgacgtgaaggattctgccgctttgcgatatacgtatacgataacgaccgatagcgtcaatttgaccacggtattaaaagaattggaaaaaatcacgcctgtactattcgaggaaaaagggggcaagatagaagtccggatgaaaaaataaaaaaattagctataacgactcatccttttagatttgtcgtgtgtctatttgataggagagcaggaaacagagtgttaaccttaaaatagatatgcgtatggattcctcataaatagataacataagaacagccgaaaagctcctacccttttcggctgccggtcgtattaaaaataaatttctaataccaactattaaaatcaatacaaatatatgaaagaaaagcaagaaagccctcggcgtaggtgccttttaatattaattgagaaaataccgaatgccatgaagttaacctttctatttttagtcatatccttgctgagtttcacggctaccgcctcggctcagcgggtttctattgtgctggacaatgcgaaagtggagaaagttttagctaccatcacccaccaaaccgggttgagtgttgcgtatagcaaacaaatcgtagatttgaatcggagagtgagcgttaattttacgaatgcagaattgacaaatgtattggataaaataacggagggcacgtcattaagttatgaagttaaaaatggaaagatctacttatttgaaaaacctctagcgaatgcggtcacccagcaagccaaaaaaataacgggtgttgttgtcgattcaaaaggggaacctatcattggagcgaatgttgtggagaaaggtactacaaatggtacgataacagactttgatggtaaatttattttggaggtatcggataacgcgacacttcaattttcttatatcggctttatgccaacaactgtcgctattgcgggacagacttcattgaatgtacgtttaagggaggatacacaggctttggatgaggtcgtagttgtaggttatggaacccagaagaaagtaaatttgacaggttctgtttcttccgtgaagtttgatgaggaattggcgaaccgtccgatcactgatgcttctcaagcactttccggaaaggtttccggcgtgtggatcagccagaattcgggtaagccgggagatgatggagcgcaattgagaattcgtggctggggtacattgaataattcggacccgttggtgattattgacggagtagaaggggtattcagccaagtaaatccgagtgacatcgaaagtatcacagtcttgaaggatgcggctagtgcggctatttacggatcaaaggccgctaacggtgtcgttttggttacgacgaagatgggaaagaataatgagaaaacccaagtagagttgaactcttacgtcggaatgcagcagatcggacgtcattttgatttagtgacgaatagcgccgagcatatgactatggcgaatcaagctttggtgaatgggggagagaaccctcttttctcggaaacattgatctctaatttcgctaatggaacagatccttataaatacccgaatacggattggtatgactctctttatcggaatgctttaataacagggcataatttatccattcgcggtggatcggagaaactatcttccttcttgtctttgaactatttgagtcaggaaggtattttgatgaactctaaggcggagcggttcggtatccgggcaaatgtggagtataaagtgaattcatggttgagagttggcgctcgtttgaattatactcgtaggaattcccaagagccttttgatttgttccgtgtattcgaacagcaacaaggtgcggctcctttcatcgctccatatacccgggatggccgtttcggttcggtagaagcgattaaggatgatggtactttattgtatacgacttatcagccggttatagacgcttcgaacggggcgactaaaacatccaaggattatatggctgtaaatgctttcgctaccgtagattttacgaaagacttgaacttacaagtaacatgggcctctaatggcaattggaaaatggttgataaatataatgagaccctttatggatatacggattctggcatagagacgataccgaaaaattacaatcgtgatggtattgtgttgagtagagagcaagtatcgactatgcgtaataatttccaagcgacattaaactatagcaagcgatttgcggataagcattatgttgccgctatccttggtacccaattggagaattacagtataaagaacgtatttgcccgaagaaccaacccacccaaagaaggattaacccaagtggatgcgggaacggaaggtatcaagggagagggaaattttgaaggtctacgcatggcatcttattttggtcgattgaattatgcctttgcggataaatatttatttgagatgaatctccgtgccgatgcctcctctcgttttaaacggggaaatcgctggggtgtttttccgggtttctctgcaggatggcgtttgagtgaagaggcgtttattaagaacctgaatctgttttctaatttgaaactacgtgcgtcgtggggacaattaggcaatcaaaccattgaaggatattggccttatttaacagtgatctcccaaaattatgacttgagttataattatggaggctcattggctccgggtgctgccgtaaccgctttggtggatgaggatattacttgggaaactacctcttccttggatattggcgtggatttgggcttcttaggtaataagttgaatatagaagctgattacttcaataaaaaaacaaccgatattatcgttcaattgccaataccaaacgtattaggggataagaccgcaccgtttgagaatgtgggcgagatgaaaaataatggttttgagttagtcgtgaattatgataatcttgagacgagcagagatcgccttggatttaacgtaggactaaactttacgtatatcgataataaagtaacgaaatttcaaggaggaaactctccggaccagctttatttgattcgtgagggatatccgtataaggctttgtatggctataaagcggttggcatctatcaatcggacgaagaagccgctcaacatatgcatagcaatgggcttaagccggaaatgggaaatctgaaatacgaggatgttaataacgatggaaaattagactatcaagataaacaagtacttggtaatacgattcctaaaattacgtatggacttactgccggcttacgctataaagggtttgacttaaatatcttattccaaggtttgggacaggcgaatgcgtttacgaagagcggcatgacccgtatgcaatacgaatggctgactatttctgataaatggcgggatgcgtggagcccagagaatccggactcaaatataccgatgcttcggtttgactcttcatgggacacgtatgactcctcattttgggtacatcgtatcgatttcttgaaattgaagaacttacaattaggttatgcgttccctgaatggattacctcaaagctaaaaatgcaacggttgtatgtatatgcgaatgcccagaacctgtttacgattatgtggaaaaaagggtatgaaggatatgatccggaaagaaatacgtttgattcgggtaccaattattacccgactccgagaatatttacatttggtataaatcttaatttctaaaagtatgaaacagttattagcatattgcttatcaattatactatgtgtctctttcacgggatgtatggagaattatttggatttgtatcctgaggataagattacttcggcgagtttcccggaaaatgaatcggatatcaaactccttttaaatggtgtctatgctcaattgagggaaaaagaggtttataatcaaggcttgtttggctttggcataacggatggagctacccctaacgcatttaactggggaacggatgaggtttttaataagctgggtgccgggcgattgagctctagtgacggaggagtcgtaacgtatcgttggaaaagatgttacgagataatctcccgggcaaactatttgttggcctgtatggatttagtggatttatcggaagaagcgaaagccaaatattcaggtgagactcattttctacggggactggcttattccgtgctagcggaaacctatggtggggtacctattatattgacgaacatttccacggaagaagctcgtagcttgaagcgggcgagtttggaggagacttggcaacaggcgttggatgattatgaggttgcgatcaccaatttgggagtggatgctcccgagccggggcgtgctaccaagggggcggctttaggtatgaaaatgcgagcctacttataccaaggtaaatacaaggaggttctggcttgtgtcgagcaaattgatgcgttgaagaaatatggtctattccatagttatgagggcttgtttgatccggctaatgagaacaataaggaagtattgtttgatatccaatatattgaaggcgagaattcgcaaggttcctatattgaccagtattgcggaacgggtaccggaagttggacccgtggaagccgttatgtccctacggatgatttggtagcggcttatgagacgatcgacggctctcctgtagatcccgagaatccttatgagaaccgggatcctcgtttaggtttcacggctgtacttccgggttcttatttcttgggctatcgtttccctaattacctgtatccgggaggtgcgtttaatcatgccggtaatcggttgaaacatttaagtacccgtaaatatcggattcaggatgagtcaaagcttcctccttccgggcagtcttatatcaatgatatcatactgagatatgcggatgtcttattgtcaaaagcggaggcgattattgagacgaatggaaatgtagcggatgcgatcgctatcctcaaccggatccgtacggaaagggatgacgttaagatctctttgctgccgacatctatgagtcgtgaggaggctcgtgagaaagtaagacatgagagacggattgagttagcgttggaaggccgttattggtcagacgtgaaacgttggaaaatcgggaagacgctttatcctatgattataaaagatcatgaaggaagcgtgatcgagacgaagttcccgaatggatatctggaatattacgatttactgcctattcctgatagcgagcgctctttgaatccgaatttggatcagaacccgggttggtaatgttcaactaaaagaaggatgaaatgaaatttatatctaaattgataccggtattagccctttccggagcggccgtggctactcaagcggcggaaaggccaaatgtgataatcgtatttatcgatgatttcggatatggggatttaggttgttacgggagtacgaagcatcgtactccccatatcgaccagatggctaaagagggaatacgactgaccgatttttatgtgggttcgagcgtgagcacaccttccagatcggctttattgacagggtgttatccaaggcgagtctccatgcatgtaaatgcggaccctacacctttgatgtccaaagggaggcaagtgctatttccagcttcgcataaaggcttgaatcccggtgagataacgatcgccgagttgatgaaggagcaggggtatgcgacggcttgtatcgggaaatggcatctaggggatcaattgccatttcttcctacccggcagggtttcgactattattatggtattccttatagtaacgatatggatcgtccgtattgtccgttacccttgatggaacaggaggaggtaatagtggctccagtcggtcatgattccttgacgattcgttatactaataagactgtggagtttataaagtctcataaggaatctccgttctttatttatttgtgccataatatgactcataatccgttagcggcttctcccgctttcaagggaaagtctcagaacggactctatggggatgcgaccgaggaattggattggtcgatgggagtcttgcttgagactttaaaggaggaaggattggatcaaaataccttggttatctttacttccgataatggtgcggatgaacacttcggcggtacgaaccgtccgttgagaggccaaaagggtacgacgtatgaaggtgggttcagggtgccttgtataatgagatggcccgctaaaataccggcgggacaggagactgataatctggtgacttcgatggatttcttaccgacattggcgcattattgcggttatgcggttccttccgaccgggtgatagatgggcataatgtgtctggaatcttggagggagaatcgatggcatcgcccacggagactttctattattaccagaaacaacaattacaggcggtacgttggggaaactggaagtatcatttacctttgaaggaacgtatcaaaggccctcacttcccggatacggaagtcggtgaagctcgtttatataatttggcgaatgatttgtcggaaacaaccaatgtcatcgataaacatcccgaagtagtgacgaagatgaatcaatggatcgaacaggttcgtagtgatatgggagattggggatgtgaaggccggaaccagcgtcctgccggtatcatagatgaaccttttccccgtttacttaaataaaaagatacgtatatgaaaacactgaaatcattgtctgttttaacagcggcggtattatcgaacagcttgagcttgaacgctgcctcggatgcggccaataagcctaattttgtaatcatattctgtgacgatatgggatatggggatttgagttgctatgggaatcccacgatccgcacaccgaatatagaccgtatggcttgtgaaggaatgaagctgacccagttttatgtgggggccggagtttctacaccaagtcgggccgcgttaatgaccggacgtttgccggttcgaaatggattgtatggagatcgggtagccgtacttttccctaactcaaaggctgggttaggacaagatgaggtcacgatcgccaaagttttacaacaaaacgggtatgcgaccggctgtgtaggcaaatggcatttaggtgcgttttctccctatttaccgacggatcatggttttgatacctatttcggcataccttattccaatgatatgagccctgttcagaataaaggcgcgcatgcccggaattttccatcgactccattgatattggatggtaagcaaatcgaatcggaaccggatcagggagaattaacccgtcgctatacggagaaagcggtatcgttcatcaaggatcattcaaaggaacctttcttcctttatttcgctcataccttcccgcatatcccattgtacacgaatgcccgtttcgagggaacgagcaaacgaggcctgtacggagatgtggttgaggaaatagactggagcgttggggaggtgttgaaggctctgcgtgaaaatggcttggacgagaatacgtttgttatttttaccagcgataacggcccttggctgacggagcatgagaatggtggttccgcaggtccgttgaaggatggcaagggtacttggtgggaaggtggcttccgggttccggccatttgttggatgccgggaaaaatcaatccggcgatcaacgatgagattatgacctcgatggatttatatccgactttcctctcgatggcgggtatcgagcaaccgaaagatcttgtattggatggcgtgaatcaaaccggattattgtttgaggaaaagcattccgcccgtgatgaagtttattattggtggggaagcgagttgatggcgatccgtaaaggggagtggaagtattattttaagacgatcaaggaccaatatctgcgaacctgtaagatcgagactccggcagaacccttgttgtataacgtggagacagatatctcggagaggttcaatcaggcggagaagcatccggagatcgtgaaattactgatcgaggccggtgagaaacataagaaaggaatgaagatcaagccttccgtatgtgatatgatgtaatgggacatttaaaaacactagattagatgaataaatatatactaacagcggcttgcggattggctttttccgcagcttccgcacaaacaaaggctttgccggatagcccgaatatcctgctgattttggtggatgatttgggatatggcgatttgtcctgtcaaggagccgccaaggacattcaaactccacatatcgataaattattaaatgaaggagttcgtttcacgaatttccatgcgaactgtccggtctcctctcctagtagagcctcgttattaaccggtcgttatccggatatggtaggcgtaccgggagttattcgtacgcataaagaggatagctgggggtatctgtcggaggatgccgtattattaccccagatgttgaagaaaagaggctatcataatgcgatggttggaaaatggaatctaggattggagtctccgaatacccctacggaaaggggcttcgatttctaccggggatttttaggggatatgatggatgattattatacccatcgtcgtttcggaaataattatatgcgtgagaacttgaaagagatcgatccacaaggacatgctacagagattttctctgattgggcgatccgttacctgtcggatatgaagcaaaagcaagagcctttcttcttgtatctagcttataatgccccacataccccgatacaacctcctcaggaatggctggaaaaggtgaaaaagcgtgaaccgtcacttcctgagaagcgtgctaagattgtcgccttgattgagcatttggattataacgtcggacgtgtgtatgaggccttggaacagaatggccagttggagaatacgatcattatatttacctctgataatggagggcaggacgatgcgggtgcgaataacggcccgttcagaggcgcgaagcaggatatgtatgagggagggatccgggtagccggaggtatttattggaagaaccagatccgtccggcggtacgtgataatttcgtcatgctttcggatatgttcccgaccttatgcgatctgacagccgtgcctgtatcacatgagatcgacggtatcagtatcttgcctcttttacggggtgaggaacaagataccggagatcgaatggtgcattgggtgcgaagggaaggtaattcccgatatggaggtcaggcatattacgcatctcaataccgggatttcaagattttacaaaatactccttgggagcctatccaattctttaatataaaggaagatccgaaggaacaaagtccgatcggggaacgatcttcagatacgtataaaaacttgttcaatggcttgatggagcatatccgtcagacgggtatggtaccgtggcaaggcaaacggtataagtgattttcccatgtgattttttagaagcacgtacatcgttattcatggtggtgtacgtgcttttttgtaattttttattgctcttaactgaatttgaatgtttttttgtatgtttgcgccaaatctgtgggagttattgtatacatgatctatatggaaatatccgatgagaagctatgggaatcgtgtctgaagggagataaggaagctttccgtgagctttattgccgattttacgcattgctgcgcaattatggaatcaagttacttcccgacaagaacttggtggaagattgcgtacaggatatttttatcaatttgattcaaaaccatacttccctctctccgacggcgaatgtcagaggatatctgcttaaggctttaagacataagctgtatgatacgatcgagaaaaacaggaaaatggaggatgtctccttatatgaggacgtgtttcaagtggatgagttattctcccgtatcgcattggatacgacagatacggacgatcgggttaaacttttgatgaaagccttgacaaaactttctccccatcagcgagagatcatttatctttattatgtaaatgaattggggcataatgagatagctagtattttaggcataaattaccaatccagtaaaaatttattgtctagaacactccgtaagttaaggcggtggttctcgttggagctttaatgtattcttggactctttttatgtcgcagtatatcaaagatatattgtgccaataattttcgccttgatggcacagtcgtgccatccaagtggcaaagctgtgccatcggtgtggcatagttgtgccatcaaggtggcacagccgtgccctagggatggcaaaagaggttgtaagaatgaaaaaaatggcggattcgctatttttcccggtaaaaagtgagtaccaaaacgaattccatccgtaataagagtaaacaggtatctcgtgaataagaaacaggacatggttgagaaggattcatttcggcaagccggagaagatttgttgcgtaaagttcgtgaagaggagcgagcggatttgcgactggcactttcttcttggcagaagttggaggaacgtttgaatgctccccgtaagacctctgttttacgtatacgctatcttgtttcttccgtagcggccgccgtcatgttgcttcttgccgtgggatgttatttttggatgatgggacatgataaatcttcattgcctttggccttgttggaggaaaagaatgttggcgccttgccgggggatgagattgtcttggtgaaggatcaaggttgggttcaactgaaagatgaagctacggtaatttatgatacggtaggcaaatcaaatgtagaggaacaccaaatagaaaagaatgagcaagaaactaaaattgatgagccggatcaaataatagtaccgaaaggacggcgtgcgaatatcgtattttcagatggtactaaaatgtatatcaatgcagagacccgggtgatttttcctacggtttttgctaaagataagcgggagatattagtggatggagaggtctatttggaagttgctgcggacccttctcgcccttttattgttaaaacgagtacgatcgaggtaaaagtgcttggcactcgattcaatgtgtgtgcttatcgggatgaacctgcggcttccgttgtattagtggaaggacaggtcgaggtgaaaaatggcgataatggtaagaatgtgctgagccctgatgatatgcttgagttaaagggtaaagagatatcgatcaaaaaggtagatgtctttgaacatatttgttggaaagataacttgatgctgttaaatgatcgtaaggttggagaggtcttaaatcggttgtctcgttattatggccggactattttatttggcaaagagataggtgaaatacctatttcaggaaaattggagctgagagagaacttggaggaagttgttgagattatttgtcaatctctttttctacgccaagagagagacggggagaataatataattttattaaaataatttgcctatgggaaaggaatgatctgtaagcgtgtttgcatttacaagagagccagaagatactgccatatcttccggctcaggagctttgtttaatcaataattacgtactaaagaaaaaacattacaaaggtatgaagaaaaaagaagatttctgccgagaatcaaatcattttctcaaaagtcttggtttagccttatgtctggtaagttttggaggatctgcgatatatgcgtcttccctatatgcgcagcggactatgctaagcattcaaatgaatgatcgtacggtagaagatgtatttgaatacattgagaaaaacagtgagtttatttttgtgtatcatggttctaacattgatttgcataggaaagttaatctggatattcgggatcagtctgtagagataatattagataaattattcagcggaacggatattgagtatattattaataatcgtcaaataatcgtacgccgagacacgaaaaaagaggatttaccgattgctagtcaacagacgaaaaaggtaaaaataacaggtgtcgtgaaagatgctcacggggatcccgtgattggtgcgaatgtagtagaaaaaggaacgactaacggcactattagtgatctggacggaaacttttccttggatgtttccgctgggaatgtgctaatggtatcttatgtcggttttcaagaaaaagaggttcctgttggggataaaaaagttctccaaatagtgcttgatgaagattcaaaagccttggaggaagttgtcgttaccgctttgggtattactcgttcagagaaagcgttaggttatgctactcaaaagttcaagggggatgaattggagaaagttaagggcgtgaatatcgcgacgagtttaagtggtaggatctcgggcatgcgagtgtataattctacggaatttggggtcgctcctaagataaaattacgtggagaggagcctttggttgtcgtagatggcgttcctacaaatcaagcgtttagtgatttcaaccaggatgtgattgagaacatcactgtgttgaaaggggctacggcctctgcgttgtatggttcccgaggtggtaatggagcgatcatgattaccaccaagaaagggggtgataagggcttttctatagaggtaaataccagtaatatgtttaatgccggacagttaaaaataccggaggtgcagacggcttatagcgccgggtctggaggtaaatttgataatatagattatgtctggggcgataagttggatattggtcgtgtttatacgcaatgggatcctattaagaaagagtatcgggaaatggagttgacttcgaggggtaagaataattttaagaatttcttggagtttagtatgatcagtaatactacggtcagtgtatcatcttctggtaagaatggaagcatccgcacttctttgtcttatttgtatgataagaatcaatatccgaattcacgtaagaataaattctggtataatattggtggagagctgaaactaggcaataaggcgagcgtggaaggtagtatgaactttacgcaggaatctgcgccgaatacggctgggtatggatatggtaccggatatatgtacaatattttattatggacaggtccggagtatgatctgcgggattacaaggattattggcttgtcccaaatgaaaagcagaattggcattatacggattggtatgataatccttattttgaggcttatgagaagattaagtcgataaataattttacgacgaatggttcattgtcttttaagtacgagatactcccttggatgaaattgcaattgcgtgcgggaggagtcgcttatgcgaataacaatgtgactcgttcttcggtgggaacgatctctaaaggccgtggtggctgggaagacggagcgctgggttattataaagagggcaagaagactggttttaccatgaattatgatttcttcttgctgtttaacaagaagctgagtgattttagtgttgacggtttattgggaggttctctttattatacgaaaacaaagaatctggaagcttccacgaagaatggcttgtctgttcccggtttttattcgataaaagcttccgtagaaagtccgatcgtggatgcggagactaagacgaaaaaagtgaatagtctgttcggtacgttgacattggggtataaggatacttattatctggaggctacagggcgtaatgactggtcttctactttgccttcaaatgataaatcatatttttatccttccgtgggagtgagtattattccttctaatataataagcttgccggattggatacccttctggaaattgagaggatcgtggacagtctctaaaactgatttagctatttatgatttagatcgggcctatacgattaaacagaatgtttgggatggcttgaatacggctagttatccggattatttgcgtggcgacgtgaagcctatcacgaatcgtacatgggaaataggtacgggtattcatttcttgcaaggacatcgcttgaaattagatgtgagttatttcaataagttgacttataataatacgatcagccaaaggatatcttccgctacgggatataaatcgagattgatgaatattgacgaagaatatgttcgtcggggagtggagatttctattgacgctactccggtacaagtccgtgatttctcatgggatgtgtcgttgaatctttcgacgagcaagaggtattacgctaaattggatgagagcttcagcccggataacttgtggacatacgtgggcgctcgtacggattcttattcatataaaggctatgacaaagatccggatggtaattatattattaatacgaatggcttgatgtctaggagccaatatagctctttgattggttatacggatccggatttagagtatggtctagcgaatgtattcaagtataagaactttacgctgacactcaattttgatggccgtattggtggaaaatcatggtcgaatacggaattccacatgttggaaaccggcgctcatccggatacggacaatcaatggagatatgatgaggtggtgaatggcaagaaaaattatgtgggtgaaggtgtcaagattgtatcaggcgaggtcaaatatgatcaatatggcaggattacatcagatacgcgggtattcgctccgaatgatatcgagacttcttatgaggattttgtaagaagcagccataataatccagataaattagttcagaaaaagacgttcttgaaattgagggaaatgtcaatcggatataatttgccgacgaagtttattagtaagttaagtatgaatagctgttatgtaggctttatcggacagaatttatttgtgttgaccaaagattttagattctcggatccggatggctttgaggatattgagggcgaggatatatcttctccgtctataaggtatgtaggtgtaaacttgaaagttgaattttaaaagctaaacgtatgaaaattaaaaatatattgatatgcggactggttttgttgggtatggttggatgtgatgatttcgaaagcgtaaatacaaatcccgactcaactaacaaagtaacatctgcgatgttggcaacagaactgttacgtgatattaccacttataaaaatgggaatggaaaggattttatccgggatgaattgttagctaagtatttgtcgtggacagaggctaatgatatagatctggcattcaatttgttgggtggagcaaattatgatgctttgagagatttgcggaatgcctcgaagatgattgattttgcgacgaatgatgagttgaaaaactcctatacggcattgtctcatttcgtacgggttttctttttcttcaatttgacaatgcaagtgggggacataccttattctgaagctttaagagctgaggatgaagaggtgtatttcccgaaatatgactctcaaaaagatgtttttctcgggttattgaatgaattggatgaggcggaccgtctctttagtgctggtactaattttgagggtgattatatttatggaggggatgtgacgaaatggcgtaaggctgtgaatgttatgcaattgaagttgcttcttaatttgtataaaaaggtcgatgatccggatttaaaggttcgggaaagaatcaatgagattatcaataacagacctgtttttgagtcgattgcggataatttccaagttgtgtactctaataaggctggacagaaatatccttattttaaggaaattaatagttttgtgaataatgacaggatgactgatctttttgttgataaattgaaagccttgaaagattatcgtttattttattatgcgaaaccgacaccgagctcagaagaagccaagttggatccctcggaatgggatgcttatggtggagtagacccgaccttaccggagtctgagatcttgacttttgtgagtgggggaactgtttctcaaataaatgatcgctacgaggaactgccggagggcgagcctgtatttttcttgagttatcaagaacaaaattttatactggctgagatggctctgagaggttttatctcaaaaagtcccaatgagtattatgaggaaggcgttcgttcttcaatgcggtttgtggcggataatacccccgatgatgttatgttccatcataatcgaaaaataacagatgcctatattcaagaatatctcggaaaccaaggcgttaagttcgctagtgattttcaagaacagttgagtcagattatttggcaaaagtacatattgacctttcttcaaacaccttacaatgctttctttgaatatcgtaggacaggtgtaccgaatattccgataaatccgaaatcgaataggaatataccttctgataaaatgccgttaagatggatgtatccatcggaagagttggattacaatatggataatgtctcaaaatcaattagcgaccagtatggagggtcggatgactatatgggtgtcatgtggattttgaaatgagaatgtcatgcatataattttccgggtcatttcaaaggaaaaaagagctctttttttgttatttctataaagatatttacctttgtctctatgttaaggataataacacatattgaacgcttattgctgacgcatgattgtgtgatcttgccgaagtttggtggtttcgtgctgcaaatcttgccggcgacgtatgaggaagaggaacattcgtttcggccgatgcgtaaagaggttatgttcaatgtaacgctacagcatacagacggcttgctttccgagtcgtatatgcagacgtatggcgttgattaccggaaagctcaattgatgttggaagaggatatcgaggctttgaatgtttctttggaacaagacaagcggataacattggggcgaatcgggactttctctataggagaggaagggcagaccatttttacgccgggcgattctggggtatttaatgcggattcgtatggtttatcatcgtttcattttccggttttgcgatcgttggaggaagagcgggaagaggttgccttacttactggtaagaaaaagaaagatgtgttctatatcccggttagtcgtaagttgatccggggtgttgcggcgtcagctgctgctgtcgcattattctttgtggtttcgactccggtgaaagaagtaaacctgtccgcttatacagctagttttgttcctacggagatgataaattataggtttgaggaaccgatttctcagctggaggaaattcaagtatcccaagaggacgagatggtagcggaggtaactcccaaaatagaagcaactaaggagacagagattgccaaagcggcttctgctcctgaggtaaagaaagagcttgttgctcccgctccgaaagtgaaatccgtggcaccgaagaagatgtatcatatcgtgatagcgagtttcccgacagaggagcaggcgaatgagtatatatccggtgtagaccgtgcgcaatgtaaaaatgtaagcaaggtggttcgtgatggtaaatatcgtatttatgcggataagtttaataaccgggcggatgccgagagctacatggcgacacttcgaaaaatagaaaagtataaagatgcttggctgttcattagccgttaataaaaaagcctgatcgaaagatcaggctttttttatgacttgtcgtcgttttgtggccggggcagtcttttcttcttcaaccgtcctgcctttcgtaaggcttggtccagaatgtactggatttggccattggtgctgcgaaattcgtccgcagcccaagcttcgatagcttccatcatatcagcgtccacccgcaggatgaagcttttgacagtattatcttttttggccatatactagtattaatattaaattcttacattaatgatgtagagtcccggtatttacgacaggttgcgctgcctcgtcagcacaaaggacaaccaacagattactgaccattgcggcctttcgttcctcatccagttccacaatattgtctttatccagtttgttcaaggcgagttgaaccatgctaaccgctccttccacgatccgttctctggcggcgataattgcttccgcttgctggcggcgtaacatgactccggcgatctcggaagcatacgctaagtaattgatacgggcttccaatacctcaatgcctgctatcgccaaacggctgtttaattcctcctccagtttttgagcgacctccccgtcatcggatcgtaaggtgacgggatctttgctctcgttataatcataggcatacatgccagctatcttacggatggcggcgtcactttgtatctgcacgaaattctcataattctgcattcgttgggataattcagaggattctcccagtgatatgaatgatttattcgaggagatactaatggacgaagaatcgatgtcgaacatcgctttataagtatccttgactttccataccatcacggccccgatcataaccggattgccgaccttatcgttaaccttgataggagggacatctaagttacgggcacgtaacgtgattttctttttgctgtaaagtggattgacccagaaaaatccgttatcagtaattgtccctttatattttccgaaaaagagcattactcgggcattgttgggctcgatttccatgaatcccaataaacaaaccactaacaggcagagtccgacgatgccggtgattacgctccaagtctcatttatgcctgcgattaaatagcagctaagacccgatagagccagtatgagaaaaagggcaagaaacccagagattctcagtccgttgaatgtcttttcagttgctttcatgatgatttatatttgatattaatttgatatcacaaaataagtgatttttatggagactgccaaatattttgagggatattattagagtgatctgtaaatattttcatagctttgtctcatctaaaaattacatgcttggactttcagttagacacgaacaataaggagtttcaggatgccttgcaactgatcactcacactcgccagtccgttttccttacagggaaagccgggacaggcaagtctacctttttgaagtatatctgtaatcatacgaagaaaaagtatgtggtgctggctcctaccggaatcgcagccataaatgcaggtggcgttaccttgcattcttttttcaagcttcctttccggccgatgttgccggatgatccggatttaagtttgtcgcatggtcgtatctttgagtttttcaagtatccgaaggagaaacggaagattatagcggaggtcgatttgattatcattgatgagatatcgatggtgagggcggatattattgattgtgtagatcgtatcttgagagtttactccggcaatatgcgattacctttcggtggaaagcagttattgtttgtaggagatgtcttccagttggagccggttgttccgtcggatcaaaaagagatcttaagtttgttctatgcgagccctttctttttctcggctcgtgtgttcaaggatatcaatttagtaccgatcgagttgcaaaaggtgtatcgccagaccgatcctgtttttatcaatgtattggatcggattcgtaataatgccgctagaaaacaggagttggatacgttgaacggtcgttattttccgtctttcgaaccgcaaaatgaggatatgtatattacgctggccactcgccgggatcaggttgattttatcaatgagaagaagttggccgaacttcccggagaagaatatgtctccgtgggaaagatcgagggggattttccggaatcctcattacctacccagctgaatttatccatcaaggaacaggcgcaggttatttttatcgataatgattatgagcgtcgttgggtaaacggaacgattggtatggtatcgggtatcgatgagaatggaaatgtttatgtcttgctggagagcggtgtggaacatttggtggaacctacctcatggcgaaattataaatacaaatataacgagaaagagagacggatcgaggaggagattgtcggtacgttcgaacaattgccgattcgtttggcttgggcgatcacggtgcataagagtcaaggcttgacttttagccgggtggtagttgatttgaccgggggtgtattcgccgggggacaaacctatgtggcgttgagccgttgtacctcattggagggattggtgctaaaaagcaagatctcttcccgggatatctttatccggaaagagatcgtggaattcagccaaatattcaacaaccaagcgttaatagagaaaagcctcaaggaaagtgaggcggaactacaatatggtcgggcggctcagggatttcggctaggtaatatgcaagaggcggtcgaggcttttgccgccgctgtatctaaacggaatgaattggataatccgatggtacaacggctgcttcgtttgaaattgcaagcgttgaatagtcaaaaggcacagattaaggctttgcgggaagagttgcattcgcttcgtgagacccagaaagagtatgcgcatgaatattacttgatgggcaacgagtgcataacgaaggcccatgacgcgaatgccgctatccgttgttttgataaggccttgaatttgaatccgaattatgtggaagcttgggtacgcaaaggggttactttattggatataggtgaggactatgacgctcaggtttgtttaaacaaggcggtaaaattaagcccgaagtcttttaaggctcgctataaccgtggaaaatgcctattgaaactcaaatattacgatgaagctattctggatttccagcaggcgataagcatcaaacctaaacatgcggcttcccacgaatatctagcggaagggttccgggcgataggagaggacgaattagcccagcagcatcaagatattgcggatgccttgcgagggggagaggatatatgatgaaatagaaaaggcgagaaaatttatttcccgccttttttatggagttatatctcttgattaattaaagatgtaacggataccaacctgcattttccagcattcagtatagatacggttataagaataagtctcagtcggatattcaccattgatcttatacatggagaaaattggagtcttgttatcatccatgccttcatatttcaagatacggcaaccgttggaagaagatgcgttcttcattacaccccatttcgagttgatcatattaccgatattcatgaaatcaaggctcaattggaaatgatgttcggttttacctgccttgaatgagaaatcttccgtaatacgaaggtcgaaacgatgtacccaaggtgcacgtgcggcataagcctcagcgtattctcccttgtgattctttaaataagaatcttggtctacgaagttccagaaagcggttctatctgcttcattcttgaatttgatttcactgtcatctttcgggatatacatcatatcattattgataccgtcgccattcatatcattcgtataagcgaagctatatccggaagcggaataaccggaatagaacagatttaagcttgtttttctgagcagacctttatggcggaagggtagattataattgatcgctgcgattaccttgtcgggcactacataccgtgaacgttgtacggttgcgaaattcggtccgtctatcgttaacattccctgccatgtagatacagggtcgctacccggaagaccggaaatttctttggattccgtgtgcgtataagccaacatcatgttcaaatcctctacgggttgagcgttaaccgtaacattggcggtataaccatgtcctttggatgtgttagttaatacaaccgcattcttaccggatacatacgtataatcagatggataaatcaaacggttatccgctccgttaaaatgttcccaatttgacgggtccttgatgttgatattctcaagggttacggcattgatgttcttgttatagatgaactcgccggttacggataatgggaaggaagtagggagctgataatctacagccaaggaggttttccatatttgtggcatcttgaagttgtcctttacgccagagatcttagaaccggcaaccggattctctatcgtggtaggaaggccgaatttcttgatcgcatcgtctacattcgtaatcatgccgccagccaattgatccagacgggaatcatgacttaccgcaattccattctcatattttgtaccgaatactacggcattttgtaccatattcgagtttgtcggcatattcgtaaagaataccaagggtaaacgtccggtaaatatacctgtaccaccacgtacttttaaggaattatccttgaacacatcccaaacgaaacctacacgaggggatatttgcattctagacttaggccatttgccggtgtcgatatgtttgcctccgaaatcaagatcgtagattgcgtcgtttctttgaagatcactattgtcgaaaattaaatcatcgaaacgtataccataagttaacttcacgttcggacgaatgttccactcatcctgtgcgtagaatccgatctggttaaaagtaacctgagctttcgggtcggaaacaccgttgtaaccgtatgtccatgcgaacgtttcaggagcggcaccgttcaagaaatcatctaagctgctgtaacgataatatcccgtaccgttgcgcatataagcattgctagcaagttggtgctcgaaactgataccagctgtgatcttatggtcgccggcaaagtaagtgaagttatcgataatacttgtgatcttgttcttcacgccgttgttgtaagtaaataattcatatccggcactcatataaggctccatgatttggttaccttccgcatctttacctgccaagatatcaatgaagggaaaaggggaagagttggttccgcgcatatcctcgatatccgtataagtgaaaagtaactgattggaaatcttatcagagaagcgactgttcaaatcagcggatacggaagacactttattgtcttgggaatacatgctgttggcaaaagacatggattggtaacctacacggcttgtattatacagacgagagccggaaccaccatccatagagttagcgttgggagcgttccatgcggtattctttgtatagttgtaccgtacgctcaatttatggccattcgtgatattccagtcgatacgacctaacaatttcaaattcttttcgtctgcggggaagttcgtggctgatcctgtatcataaccatatttatctcttaagaaatcggataccttttgcatgtcggagagtgtagtgcgagatatgtagttattctcgtccggttgctctccttcggtacgagctctccatttgatcacttgttgcggttgtttttccacctctacattggcgaagaagaataatttattcttgatgatcggaccgccgaacgtagctccgtaaatcgttttggattccttagcacgtgcgcccaagtcttctccatcgattgagtttcctcgcatattctggttctggaagtaagtgtaagcggaacctttgaatgtgtttgtaccggatttggtgatagcgttgataccgccaccaatgaagtttgtctggcggacatcgaacggggcgattaccacttgtacttcctcgatagcgtccatagagatcgggttaccgcctccgggaagattatccgaaaggccgaagttgttattaaagttcgctccatctaccgtaaagttcgtggaacggccatcgccaccggcaaaactcatgtcggaggcataaggagaaaggcgtgcgatatcggagatactacggttaatggtgggtaaagaggtgatctgtgacgaggagatattggttgtcgcacccgtcttttccgtattgaacttcgttttcgccgctgtgattacgatctcgtccaaggtctcagaagattctttcaacttaacattcaagttgtagttctctcccaattgcagggtaatgccggaataaacggcagattgataaccaacgtaagagatcgtaactttgtatggacctcctgtacgcataccttgtaaggaaaagcgtccgtcaacgtttgtgatcgtaccataatttgtcccagaaggttcgtgaaccgccaaaacggtcgcaccaataacgggttcatcttgaaacataactgttccactcatactggctgttgttacctgtgcttgtgtcgggatgacaaacaagaaactcagtacagctaaaaggaatagcgtctgtaaatgtctgctcataatttaaaatagttaatgtaataaaaactttcgcaaagttatgggttattttttaatatcattgtatgtttcttatttaatacttgtttcatattcatgaagttgctgtgacggggcggaattgagtaatgtccttattcggagatggatggcttgtattggcaaaacaagagggttctttatgaaatttttaatttgatgattcttaactaacattccctgttgggcggtgatttaaaagaattatagacgcttttcctgcatattgttggattatggatgtgattggttgagaataataatctggagatctgtgtgaggaatgttaatgctatgaatattatatatagtttgtgacaaaaagagatatctaatccctatctttgcggcgatatacaaaaatgttataattattttaaatataaatacttcttgtatgaggaaaacttatctacttttaacgttacttttgttgtgcgtgggaatatccatacatgctcaggtgacgacggcgagtatgagtggtaaagtcacggatacatcatcggaagcgatgatcggagtgaatatcaaggctacgcatacgccaacgggtaccgaatactacacgattacccagccgaatggttcttattcttttaacaaccttcgtatcggaggcccttatgtggtagagttctcttatattggatacaatacggagagccggacaggaataaacttggttttgggtgaggatctgaaactgaatgtagtaatgcgggaagatacccaagctctcgatgaggtagtcgtggttgcggataagaaccccattatttcaggaagccgtacaggtgcgcaggaaatcatcactcgtgagaagatggataagctgcctacgattaaccgttctttggatgatttcgtgaaattaaccccgatgagtagcggaaagaattttggcggtgtctcttaccgttttaataatgtaacggtggacggtgcctcctttaataactcgtttggtctggcttctgctcttggagcttccggtacggaaccgatttctttggaggcactcgagcaggtacaggtgatgatcgctccttttgatgttcgaaatggaggattcacgggtgcgggtattaactccgtaacgaaatccggttcgaatgagtttcatgcttctgtatatatgtacacgaagagtccgtctatgatgggatatcgtgtgaaggatgagacgattggtgtttcagagttctctaatcaccaatacggtatcagtttatccggtccgatcattaagaataagttattcttcttcatcaatggtgagatggatcgtcaggaggaaccgatttcttatacgaccgctaattctgcggcggatgcgacagtcttgcagggtttatctgatttcttaggtgatgagcttgggtataatccgggtaaattcgacgtgaataagacaaatactcaagcggatcgaatcacggctcgtttagactggaatatcaactcaaataatgtgttgagcttaaaatattattatttgaaatcgtttaatacgaataacccttctacttccggtgcgccgaataacggacgtggaccgaatgcgttcgctattccgttctcttcttctttctaccggacgaataataacttcaatatttggatggccgacttgaatacgaccattaatgaccgtatgtctaattatttgaagatcggttattcccgtttgcgtgattatcgcgatatggatggtggttacttcccgcaagtggatatcttggatggtgataacaatgcttatacgactttcggaaccgaggcaaactcctataataaccagttgaacagtgatatctggcagatacaggataacttcttgatgaattttggcaaacatcagattacggttggaacgcaaagtgactatcgcgcctttaagaatggtttcgctcaaaactatccgggttcttgggtatttaactctgtcgatgatttcaagttcaacgtattggctacaaaacaatacatggccgctcataacggaagtgtacaaggatttgatatccgtgagtttaatccgaaagattttggatttggttccaatgtgacaggtattacgaattcttcttctacggggtaccagtactatgcgcaaagatattcgatgacggatgattttccattcgccgagataaatgtattccagttaggtttgtatgcccaagataagtggacggtaagtgataaattgaacttgacgttaggtttacgtattgatgttccgttctttatgactgatttgcagtcgaatgataaagtcgccgccgagacctatcgggatggcatcaagatcgatgtttctaaatatccgaacgccaaacctcagttctctcctcgatttggttttaactacaaaccgtttgacgatgagaatggaagtttgcagatccgtggtggtacgggactcttcacgggtactcctccttatgtatggatcagtaatcaagccggcaacaatggcgttttgtttggtgacttgaatgtccgggcggtaaaggacaagaatgacaatatcattagcgatggcagaccttcgctaggttttaccggaaatatggatacttataaaccggctgaaggtagcgctacccgttcggatatagcgattacggatccggactttaaatatccgagcttatggaaaagtaatatcgctgccgattataagtttggtgatggctgggtagctaccgtagagttgctgtactcaaaagacattaacgctatttatcatgacaatatcggattgtatcggaccgagcaatttgtaaatgacggtggagcgggtaacgcacgtccatattataatggctattatagcgatagggaaggaaatcaaaaggccgcgaatcatgtcgtgatgctgcgtaataccagcaaaggacattcgctttatacgaccttccagttgcagaaaaactttgttgatggaatcttgaagggattgtatttgaatggatcttactctttcgggcagtctagaggtgtaacagacggaacatcgtctgtggcgacttccgcttggaagtaccgtgcggccttggacggaaatgcggaagaagtaggttatacggcaggttcttttgatggtcgtttgttattgtccgcttcttatacggctaactggagtaaatatgcggcaacaagttttggtttgatctatcagcgttatcgtccgttccgttattcttattgttataatggtgacgcgaatggcgattctcagttctccaacgacttgatgtatatccctgcgaactttgacgaggtaaaagatcatttgttaccgggcgatttcgatagccaagaagatgcatggaaagcgatgaatgcctttatcgagcaagatccttatttgagcaagcatagaggtgagtatgccgaacgtaacggtgctgtcgctccgttcgcaaatcaattggatttgagcgtttctcatgatataaagatttaccagaagaatggtcgctcacataccttgcgctttagtttcaatatcgccaacttcttgaatttgttgaatcgtaactggggtgtggtacaaacaaccgttttgggtaatcagcaatatcagttcttgacgatcccgaaaggacaaggcccgagtgcggcgaacaactatacgttgaagtatacgatggcgaaagatttggatgagaccttcaaggataatttgaacgatgtgtctcgttggcagatgcaattcggtatcaagtatatcttctaaaagaaaaatctttcattagataaaatttaataattagaggaggttcactatctttgtggacctcttttttaatttaatgatatgtggaataatcgtattgagttcttactcgttagtttcttttgtatttgttcattggcttttaccggttgccaaacgaaaaaacgatcggatcgttatgtcgtagttttatcaatggacggtttccgctctgattatccctcacgtgctcatactccgacgttggattctttggcgaatgtaggggttcgctccacgtttcgcccatgttatcccagcgtgactttcccgaatcattatagcatggctaccggattgcatccggatcaccatggtttggtaaataatttcttttatgacgcggagcttgatagttcataccggatgggaaacctggatccgcgattttatggtggagaacctatttggaatacggcggaacgccaaggggttcgtaccgcttccttctattgggtcggtagcgaggtgcctttggcgagtggccagccttcaatatggaagccgtttgataaatcggtttctttttcagatcgtgctgattccgtgatctcttggctgaagttgccggaagatatacgtcctcatttgattatgtggtatatggaagagccggatgcgataggtcattccgctaccccggattcctcggcaaccttggatgtggtagagaacttggataaagtcttgaatcatttcttcacggaagcccgtaagctggatattttcgataagatcgattttatcgttctctcggatcatggaatggccacctattatcccgagagatatgtgaacttgaatgattatctaccccgggatagtttcgattatgtctttgatggtgttcctacattattatatccgaagaaaacctatgtggatactgcctatgcgattttacagaaagtgccgaatataaccgtatggaagaaaaacgagatccctgagaaattggtttacggaaagaatcctcgagttagtgatctggttgtttctccacatattggaacgtatgtgcaattccgcgagaaatcatctccccgttatgcggcgacacatggttacgataattttacaccggagatggaggctatattctatgcggcaggtccctcgttcaagaaacacgtagaggttccgcaaatggcgaacgtgaacctctatttgatgatcgcacgcttattgaatatacagcccgccccgaatgatggagatagcgctgtcgttcagcggttatttaaatgataggacttcgcgctactttctaaatggagatttactgcacgggccttgcagtactactgtaaagccggttgcagtaattgatgccttattgatgttcgcatgtcatcttacgcatgaaagcgagactgcctttagctagctcatctgcgttgtatttagatggacgccaaagagatacgacttccgccatgccgggaacggaattggagaaattctccagaactaagttcccattgaaatcgatttcctgtagtccccggaacaaatcatcccagcgtacgtttccctcacctagcattccccggtcgctttcagtcatgtgaatatggcgaagtcggctgcctgcggcgataaccggttcatagaaactagtctcttctatattcatatggaaagtatccagatgcaaagataaattcggagcgtctatgcgtttgataaagcgcaagacttcctccgcggaggtacacatatagctttcatagcgattgatcggctctataccgatcgtgattccggatcggccggcgtattcggcaacctccgcccatacctcacaaagcgtattctcttcttcccgtgttcgctgtttgccggagaagaccccgatgccggaatgtaagacacctcccaagtaatcaacctccagttcgctcgctttatccagcgccgccttgatcaggcgagtcgcttccttgggataaaaaggaatatgcgcttcttggggaaggttgagagaacaagtcgccttcaatccgtgttgtttcaattgtcgctttacggttggagcgtcgaactccatggaaggaggcaataagatttccagtaaatcaaaaccggcgacagatgcttgctggatggcgaaaagaccgccttctggtgtccacataggtggtatccaagaaaggatggaagctccgaaagtaggattcataatcgtattgtttttattcgttagggttacaaagtaagtacttttttgaagatttcattgcgaagaaagtgaaatccttcgcaatgaaatatcataaatgtcatttaaaaataaaagttggtacccggacagaagatagggtggctgctggtgttatcaatttcaatcttattttctctagcgagccaaccgatagcggaccatagatccgcatctgttagagcggattttgctctcaacgcctcaaaactccaatgttggccatctgaaagcaaattccagatagctcctgcatttaatccgatcgatccttttgtcatgataaaatctgtttttatgtttatggtatatagtgcttatattgttataacagataatatccggtaaaagtatgttgcgttgagataaataatctaaaaaacaaaaatctcttgatgcgttgaattttattccttgaagtcagcgaatatggattcatcgtatacattgtgttcctttttatcgtggaatggataccatacttgggcaaagaacggatttcctttagcgatctcgtcgtaattccaagggagcggtaaacattccgggcaccaatggcctcctaataatactaatgtgggagaggccttaaaacggtgaccgaattggcattcccaatcgagcggagtcgataagtctccttttgtcatggccggggacaagcattttcctcccctgaattctgcggctttacgcatatcctcgatatcccattccgacttcggcttactttcatcataaccatgatccagaaagacgggtgtttcggaggggcgttttgtccggatcttatcccaacccgggattgcttgccaatcctcatacgagccaaaataggcggatatacgatcttggtgtctgttcttgatccagttacgggttcccagtcccggctttttagcgatggctcccatacccagttttatgaagataggagggacgatctttgctaggtggaaataccaagggacttggctggccatccatttaaaataatcgtcgcaagtttggttactgcggaaatgcagatatccttccaataggtctgaatcggtataccattgtccgtggaaattacggatagcgaaccagttcggttcgaatattttctccggggcgggacagccgatcgcttttaacaatttactctcaaactcataattcgtcaggcggaaagatgggccgctactaatgttatagaaacggttccaaaactcatccggcacctcttcctcgcatacattcgctagtaagcgaccggaatcctcggcggtagcccattccagcacgccgtctagcggtacatggaatgtgattgggtccgaacccttgaataataattcggggcataagataccggtttggcgaaggcacgcccaatgtctaatacccgactccacgaaaatacgttcggctattgtctttgagatggcataatggtcataaacacttatattgatcggatctcccgtacgtccccaatgaaccggtgcgttacggtggccggtttgcgccacggagccgatatagactaccttgatctgatctgcgttcggttgcgcttttacggcatccacgatgtgttgagcggcggtcgtgtttactttcaaggtctttttagggaaataatccgccgccggcgaaaccattccacctacgtgtaatacgtagtccgctcctgttactccatttaggacatcctgataactcgtcaagtctccccaaacgatacggatccctgccacggcctcataggtggccaacttctctttattgattttgctcggacgagccaagagtgttatattaaaacgatctagccgcttggacaactcgaccaatccggcatggcccatcgtcccggtggctccggtcagaaagacggtctttttacttttcatgatataatttaagtgtataataaaaatcttaggatactatcgggtagcgaaggtatataaaaaaaaactcccaaccaataggttgagagcttttgtagtggatacgagaatcgaactcgtattacatgcgtgagaggcatgtgtcctaaccgttagacgaatccaccatttagatgtcattgtttttgtttgacgatgcaaaggtagatatattttttaattctgcaatagttggactgagtttttttgaagaaaaagtgtgttttttatcaaaatgccaagaaaacggggagaataccactaaaaggcgttaaaagtagttgcgatttcattgttttttcattgtcggtactgtttatttattctacctttgccatctgtaattgaacaaaatagtattgaacattactaataccagtttaataaacaactaatattatggcagaacttaaagaaaaacttttctcagaattcgcacctgtgtctactgaagagtggatggcgaagataacggccgacctgaaaggggtaccgtttgagaaaaagcttgtttggaagacaggcgaaggatttaatgtaaatcctttctatcgtgcagaagacatcgagggtttaaagactacagagtctcttcccggtgaattcccttatgttcgtggaacgaagaaagacaacgattggaaggtacgccagaacattgaagtttgctgcttcaagggtgctaacgagaaagcacttgaccttttgacgaaaggtgttacttctcttgggttcatcatcaaaggtgatgaggtgaacgaggagaatatagctactttattagaaggtatttgtccggcttccgtagaattgaacttcaacacttgcaactgcaaagcggagaagttgatcggtatcttggctgactacttcaaaggcaagggtgtcgacgcagagaagtgctacggttctgtaaactatgacgctttcaagaaacctttagtaaaaggtaaagaaaacagtgagtgggtagaaggtgccgcagctgtgctcaaagctggacaggctttgcctaactaccgtgtattggctgtaaatgcgttccttttcaacaatgctggcgcttacatttctcaggaattaggttacgccttggcttggggtaacgaattgatggcaaaacttaccgaggctggtttcaccgctgacgaggttgccaagaaaatcaaattcaattttggtatcagctctaactacttcatggaaatcgctaagttccgtgcggctcgttggttgtgggccgagatcgtagccgcttataagccggcctgcgaatgcgcttgcaagatggttgctcacgcacagacttcagagtggaacatgacggtttacgatgctcacgtaaacttgcttcgttctcaaactgaggctatgtctgccgctcttgccggcgtagactctatcacggttcgcccgtttgataagatttaccagactccagacgatttctctgagcgtatcgcacgtaaccaacaattattattgaaggaagagtgccacttggataaggtcgttgacccgtctgccggttcttattatgtagaggtattgacgaattccttggctgatgtcgcttggaagttgttcttggaggttgaggaaaaaggaggattctccgttgccgtgaacgcaggtgagatccagaatgccgttaacgcttcgaatgtagctcgtaagaaagcggttgctacccgtcgtgagatcctgttgggttctaaccagtatcctaacttcacggaagtagctgccgataagattcaggaaaaaggttcttgctgttgtggcggtggtcattgcggcgaggcaacgatcccggctcttgatttctctcgcggcgcttccgaattcgaggctttgcgtatggcgacagagaagagtggcaagactccgaaggtattcatgttgacgatcggtaacttggcgatgcgtttggctcgttcacagttctccgctaacttcttcgcttgtgccggatataagataattgataacttaggcttcgatacggttgaggctggtgttgaggctgcagtcaaggcgggtgctgagatagtggttctttgctctagtgatgacgagtatgctgaattcgctcctgctgcttacaaggctttggccggacgtgccgaattcgttgtagccggagctcctgcttgcgcggacgacttgaaggctcaaggtatcgaccagttcgtaaatgtaaagagcaatgtgcttgagacattgaaagcattcaacgctaaattaggaatcgcttaagtataaacaattatgagaccaaattttaaaaacatagatataaagaatgccggattcgcagctacaaacgctgccgaatgggcaaaagccaatggtatcgagcccaattggaaaacacccgagcatatcgaggtgaaacctgtatatacaaaagaagacttggagggtatggagcacttgaactatgcttccggtctgcctccttatctacgtggcccgtacagcggtatgtacgctatgcgtccttggacaatccgtcagtacgcgggtttctctaccgctgaggagtctaacgctttctatcgccgtaacttggcttccggtcagaaaggtttgtccgttgcgttcgaccttccgactcaccgtggttacgatgccgacaacgaacgtgtggttggtgatgtaggtaaagcgggtgtatctatctgttccttggagaacatgaaagtgttgttcgatggtattcctttgaacaagatgtctgtttccatgaccatgaatggtggtgtgcttccggtattggcattctatatcaacgcaggtttggagcaaggtgctaagttggaggaaatggccggtacgatccagaacgatatattgaaagagttcatggtacgtaatacctatatttacccgcctgagttctccatgaagattatcgctgatatcttcgagtatacctctcagaagatgccgaagttcaactctatctctatctccggttatcatatgcaggaggctggtgctacggctgatatcgagatggcttatacgttgtgcgacggtatggaatatcttcgtgccggtatcaacgccggtatcgatgtggatgcgttcgctccccgtttgtcattcttctgggctatcggtgtaaatcacttcatggagatcgccaagatgcgtgcggctcgtatgttgtgggcgaagatcgtgaagagcttcggcgctaagaacccgaaatcattggcattgcgtacacatagccagacttccggttggtcattgaccgagcaagatccgttcaataacgtaggacgtacttgtatcgaggctatggccgctacattaggacatacacaatctttgcatacgaacgcattggatgaggcgatcgctttgccgaccgatttctccgctcgtatcgctcgtaatacacagatttacattcaggaagagactaagatctgtaaggaaatcgacccgtgggctggttcttactatgtagagtctttgacgaatgaattggtacataaaggttgggcgttgatccaagagatcgagagcatgggtggtatggcgaaagccatcgagacaggtcttcctaagatgcgtatcgaggaagcggccgctcgtacacaggctcgtatcgactctggtgttcagaccatcgttggtgttaacaaatatcgtttgccgaaggaagatccgatcgatatccttgagattgataatacagccgtacgtaacgagcagatcgccgctttgaaggagttgcgtgctaaccgtgacgaagccgctgttcaaaaagctttggctgatatcacggagtgcgtgaagacgaagaagggcaatttattagagttggctgttaaggctgccggcttgcgtgcgtcattgggagagatctccgatgcttgcgaggtggttgtaggtcgttataaagcaatcattagaactatttcaggcgtgtattcatcagaaactaagaaagacgcagacttccagaaagcttgcgagctttgcgagcaattcgctaagaaagagggccgtcagcctcgtatcatgatcgctaagatgggtcaggacggacatgaccgtggcgctaaggttgttgctaccggttatgctgactgtgggttcgacgtagatatgggaccgttgttccagactccggccgaggctgcccgtcaagctgtagagaacgatgttcacgtaatgggcgtttcttctttggccgctggtcataagacgttggttccgcaggttatcgaggagttgaagaaattaggtcgtgaggatatcatcgttatcgctggtggtgtaatcccggctcaagactatgacttcttgtataaggctggcgttgccgctatctttggcccgggtacttccgtatcgaaggcagcttgccagatcctagagatcttgttaggcgaataaatagcatttaaaccttacggttttttaataaagagaggctggacaattgattttgtccggccttttttagtattgtatacgggtttatgtacttttgtagcgattattcaattaaaaagggaaagaatcatgggaatcgttataggtatagacgtgggaggtagcacgaccaagatcgtcggtgtggaggataagaagatcaagaacccgatgttcgtgaaagctaccgatccggtaacctctttattcggggccttcggtaaatatatttatgataataacatctcactctcgaatatagagaaagtgatcttgacgggtgtaggtagcgcctatatcgatcaacctttatatggcttaccaaccgcgaagacggatgagttcctcgcaaatgggctaggggcgcagtataatacgggactggatagcctgttggtggtcagcatgggaacgggtacctcttttgtcaaggtacaaggctccacggtcgagcatatcgggggattgggtatcggtggcggaaccatcctcggcttgtctaagctattattgaaaacgcatgactttcaccaaatagcgtctttggctgagcatggttccctgaatgatatcgacttgcatatccgggatattacgccgcatccgctacccggcctgccgctagacgtgacagcctctatttttggaaaagcggatgcgaacgctaaggttgaggatatcgctctcggtatcgttcatatggtcttgcagactatcgggcaaggagctgttttcgcctcgttaaatggcgatatcaagaatatcgtgttgatcggtaacctgactcgcttgccgcaatgcccggatattttcccccgtctggaggagatgtgcgatgtccatttcaagataccggagtatgccgagtatcgcacggctatcggggcggctttatgttatatcaggaaccgggaatatagggatattttttgtggaaagtgttaggctacatcaaaactttatgtatctttgctacatgctttgttccctttcggcaatcgccggatagggattaaaagggaatcgggtgagaatcccggacagtcccgctgctgtaagcttcataaacgggttgagcaatactgttgccactgttcattcaagtgaatgggaaggcgcttaagaccggaagtaagtcagaagacctgcaaggcgtgtatattttcgacggcttcgaggaaaggccggaagagaacgcaagaaccgtatccggtttttactattctttatccaaggttttcttatcaagtcgtctcatggtttcggataattattttgccataataattagggaaagaagcatgaatctgaccgacgggatgagctccgtatgtaagatgcatgctttctttgagtttaaaggactggggtattccgtgaacactctatagagaatatttgtttattattagaaaagtgcgtttatttgcaacgagtaattaacaaaagaagtatgaatatgaagaaaatcgtgggatttcttatggttgccttgttagcgttgatggcgcttccggcgaacgctcagcttaaattcggtatcaagggaggtgtgaatatatcgtctgtccatttcaactcggacgtgttgaaagcggataacgtaaccggcttccaagtggggccgatgatcgagacgactttgccgttggtgggtgtcgggatcgatgcggccgtgttgtattcgcaaaaaggtttggagacgacttcggttggcggggttaagacttcgatgaagacggattatatcgatgttccggtcaacttgaaatggaaattcggcttaccgatcgtcaaagcgtatctggcagccggtccgtatatcggtttccgtgtaggcggtgataaattttgggatatcccgggttccgtagcggatcaggtgaaggcgaagaatttcagcgcaggccttaacttcggtgccggcgtggagttgatcagccacttgcaggtgggtttcaattatggtctgggactgactgataactatagcattgagaaggtgaacctctccgacggtgccggaaagaatcgtggatggtctatcacggcagcgatcttgttctaaataggtgaaaataaaatgagagaggctgggctttagaagtccggccttttttgttatttttgggctcgtaatgaaacacctgtttgaatgaaatatgcggacgtcatacttccccttcctttggagaatagctatacctatcggatacccgaagatctggaaagagccgtgactcccggttgccgggtgatcgtgcatttcgggaagaaacgatattatacggccatcgtcatggaggtacacgaccgggaaccggtatccgattttgagacgaaggagatctacgctttgctggatgccactccggtgctccgccgtccgcaactccgtttctggaaatggatatcttcttattatatatgtaagctgggcgacgtgtataaggcggccttgccttccggcttaaagttggaaagcgagacggcggttacttataatgaggatttcgaggctaccgcccccttgcgcccgaacgagcaagcggtactggatgcctttagcggggttttgaaattgacgatctcggagttggagaagaagaccggtctccgaaatgttgtcccgatcgtctcttccttgatggtgaaaggggcggtcgaggtgagcgaggagctaaagcgaggattcgttcccaagacacaggcgtttatccgtttggccgaagcttactgggatgagacgaaattgcaggcggtgttcgaagaattgaaaagggcgaagaagcaagagcttctgttggtcagcttcttggatttaagccataccttgaatcccgctttatcgaaggagctttccaagaaagagctattggaacgcagtggttatacctctgcggtattggagggtctgctgaaacggggtatcttggagagttacgagaaagaggtgggtcgtttacaagtatccgtctgccgcttgcaagagccgaatccgctcagtccggcgcaagagaaagcctacggagagatccatgaggctttcaagacgaaggaggtttgcttgcttcatggcgtgacttccagtggtaagaccgagatatacgtccgtttgatccatgaggtcttgcggctggggcggcaggttttatatatgttgccggagatcgctatcacgacccagatcacggaacggctggcgaaattattcggggataagctattggtctaccactctaagttctcggacaacgagcgggtggaggtctggaacaagctgctgcatagcgacgagcctatgctggtattgggggtccgttcttccctcttccttccgtttaaggacttgggcttgattatcgtggacgaggagcatgagaatacgtataagcagcaagacccggcaccccgttaccatgcccgtaacgctgccatcgtcttggcgggtatgcacggcggtaagaccttattgggttccgccaccccttccatcgactcttatttcaacgctacggcggggaaatacggtctggtcgagctatccacccgctacggtgattgcttgatgccggagattattacggtggacgtgaaggagctaaagcgcaagaagattatgaaagatacccttttctcccccctgttggtggagaaggtgcgggaggctttatcccggggtgagcaagcgatcttgttccagaaccgccggggattcgccccgatgatcgagtgtcgggggtgcgggtgggtgcctcattgcgtgaattgcgacgttagccttacttaccacaaggcgcataatcagctggtttgccattattgcggttatacttaccgcttgccgcaggtatgtcccgagtgtaaggggacggagttcaagatgcaaggtttcggtacagagaaggtagaggaggagatcgctgggcaattccctgcggcgaaggtggagcggctggatttcgatacggcccgtacccgcacggcttacgagcggatcatctcggatttcgagaaggggaagacacaaatcttgattggtacccagatgttgtcgaagggattggatttcgggaatgtcagcgtggtcggaatcttgagcgccgatagcctgatgaatttcccagacttccgggcgcacgagcgggcttatcaattgatggtacaggttagcggacgtgccggacgacgggataagcggggtacggtgatcttgcagactacccagccggagcatcccttgatccgtatggtgcagcattttgcttataaggaaatggtgagcttgcaattgagcgagcgtagtatgttccgttacccgccttactaccgtttgatcgtcttgatccttcggagtcggaatgagaaggctttgcaggaaatgtctgctttatacgccgagaaacttcgtgctcgtttaggtgagcgggtgttggggccggttacgccgcctatcacccgggtacagacgcttcatatcaagaagatcgtcttgaagatcgagatatccgccgggatcgctccgcttcgtgagatattggaggggattcatacggagatgcagggatatgtgccgtttaagcagttgctggttcattatgatgtagacccggcttgagaattgaaaatggagaattgaaaattgaaaattaatggaaaggagcttagggatgagggaggaaaagatacggttgttgtttgtgtgtttggggaatatatgtcgctctccgtcagcggaggcggtaatgaagaagttggtgaaggatgcgggattgggagatcggatcgagatcgattccgccgggatcaccgggtatcatgagggagaccgggcggattcacggatgcgggcgcatgcggcccgtaggggatattcgttggattcgatctcccgtccggtacgtcagtgggactttcatgacttcgatttgattatcggcatggacgaccaaaatataacggacttgaaacggatggctcccgatctggaatccgtcgctaagatacatcagatgactgagttctcccggaataagttgtacgatcacgtcccggatccttattatagcggtgccgaaggtttcgagttggtcttggatctattggaagatgcttgcgccgggttgttggaatattgtaaagaccatttgtcttaagttcggggcgaagccggatcagtaaagaggttgttacggctatcgttcaacttcttttactaaccatttgatttcgttatcggtaatactttcactctcttccttatcataaatataaatgaggttgataatcccttcggtatcattaacggtataggtataggtgatgactcgtgcgccatgactttttcctttgtttttactgcctatagccatacggatcttacggatgccacagcctaaatcaattcctgcggaagggttgctgcttagctcattttgtaacgcttgaaggtcttgttttagcgaatgatatttctttgccaatcgcttcagctctttcagaaagtgcttttgcggtatgattctataattcatctatgacctcctgcaatgttttttgatatgtgccgtttttacgagactcttttacgtcgattaagccttgccggattccggcaagcacctcttccttactaatatattcagtctcttcagtctgtgcttccttttgctgcgcaagacggcggatggcttctacggctttacgcatcaaggtctcatcttcggcgatgatactgagttggcggaataattctgcgttgagttctaatgctgtcatatttttatccttcttttgtctctggttttcaatggcaaatatacgaaatagaatcagttagacaatgcttcggtagtttattcttgtgactgtctttattctattcccgtcccggatccttattatagcggcgccgaaggcttcgagctggtcttggacttatctatcgtaaggttgctagaatgcccattgtaagatgcttataactgcgattataagaacctaacaatgggcattctaataacctctttttgtgagagcggcgatgacagccgctctcactcgtgaaaccttgcctatcggattatcactttcttcgttatctcattggataggcggacgatatagataccgctagccaagccatctacacgactgtctccggcgggaagccgtaccgtgcggactacgtttccggtgagggcgatcacctgcgctgtcacggagactggcgtacggatcagcaaggctccgctctcggcacggatcaaggtagcgttttccacttgctcgataccggtcgtggtatttctcacgataccggtgatcgctacggtcaggttggcggaaatatcggcgatcgtgtacttgccgcttgcgtcgggggtgagggcgtttccgttcacggtcactacggggacggactggtcatagtctgcgtccaaggtgagggtgaaggagaagccgtcgccttcggttaccgtatgcgctccggctgccggggtggtggaggctcctaccaaggcagggagggttacggtataggtagcgggctgtggcgtaggaggcgttacgggaggaacataaggcgttacggcaaccgggggcgtggtgagcgtcgtggtcgtggtcgtgccgccgtctccggttacggtggcggtaactaggcaacgatactggcctacggttctcgtcctgtaggtattcgaggcgttacgcagctgcgagtcgtccggggcggtagaccatgtgccggcctgtgcgttgaaagtctcccattgatacgtcaaattcatttgggtgccttcgggggcggttatgccggccttaagctccgcgtagccgtcagtggatggtatcggggtgcttgccgccgggtctacccgttcgagggtgatgttgccggggagtgtcacggtgggcactcgtgcggtaagatccgtgaaatggccgttgttggtgaccgcggtgttgacaaggtcgccggcattctcgccgggggtgagcgtcaattcgttgccgggctcgatcgtgaccgcacccagactgttcgtgccgctcaaggtgaggttggtcttcccggtaccgttgatgagggtggccgcggaggttacctcgttgagctttattgtcatatcggtatcggcgggaggggtgagggtgagtttgtttatggtcttgcccttctctccgttgatctctccgttgaagtagttgtcggtaccatcatcttgttggaacttgttctcgtccgttatcgtgatctcgccgttgtctgccggggtgataggggaggcttcgaggtagacctgcgtggtgccgttcatcacgtacccattgcctttcacgccatcaggcagcggtgtggctgtccagatgaaggggttcttcttgccgggcgtgaggtcgagggtagcgccgtctttcagtttccacgagatcggactatctatcacgtcgcctctgtcggtggtgaaggtgagcttgggccatgtggcggcaagatcggccagtatctcatcggcggtcatgatggtggtgacgatccgggtctcggtcggctgtcctaccgcctctgccagctcgctctctttccattgggcggtgagggagagatcgccggtggagcctttcgccacggtcgctaccgtattcccgtcggtgtctttccagccctcgaaggagaggtaggtattggcgtgtgtcggcgtggggagggtgaactcgtccgatactacggtatattgggtggggctgccttgcgggagggtgccgccattcgggtcgtaggtgatcgtgtagcggataagctcggcctcggcggtaaccgtcgtcggctgggcgggcatcgtgaagctacgctgtgcggtgtagcccttgtcgttcggtgccagggtctctgcggtcgtagcgttgccgttgtaggtgatggagcctaccgtcagttggtagccttcctgcgggacgaagaagaggtctaccttggtcccgttgtagacggtctggccggaggatacggcggtgtacgtgccggcggcgttcatgatcattacgtccagcgtcgctccctcggcgggttgctggatggtgaggaggtatgggaagaccgggtcggaaggttgcgccttcgtgctcgtctccggggcttgcgccatcgccggctgcgctagcagggcgagcgtagcggctagcaaggataggatatatctgaatgttctcatatttgtatctgttttagtgtatataatataatgtatgctctacaggacgaccttgatcgttgtaccgccttggtggacgagatagatgccggaaggaagggcgatcgtcgtctcgctgcgcaagagcggcaggtagcacttcaaggtcccgctgacgtggtatacggcgactttctcggcatggtcggcgctaaggtgcaaacgtccgtcggcggcccaagcgcggaagctgttgtccgccggagtctcggccagctccgtacccgtgacgataccgtccaagcggaggctcttcagcagggcttgggtggcggcattggccacgacatagctctcgaagggccgcagggtaacccggtccttcagctcgaagcggctgccgtcgtcgctgaggacgtatatgtttcgcatctccacattgtacgaggcccgattgcccttgaagaggaacacgcccgtgttgagcggctcggcggggctggtaggctcgatgggggagtcggggctgtccttgaaaaggtagatattgccgtaattgaggcgcagcgtgtttgtctccgggccttcgccggcgatcagcacggggttacctgcggcgagtatatgcaggttgtcgggatccgccggctgccaagtctggtcggtggcatcgggatatccggtacgcacgtagcagggggttcccgcgtcgctagccaatttgtcggcggtattggatgctagcgtggtagcccgccattggttgcggttggggaagaggtgggtgaagcgggccgctacgagtcctagcacaccgtcatcggcgaaccggatctgcccgccgtcctgcagctcgagatcattcaccagtggaaatactccattttctcctatcttccctaccgtaaggacacccttctcggtgacgcgcagccattggcccggcatgctcgcgtcgaaggccgtctccttgtcgatcacgatccagacgggcgggacttcgcgcaatcccgtgtagcttgtcagcccgtcgggatgggcggcggggaaggtgctgaggtaggtttgccccgggtcgtcggagcggtagccttcctgtttcaagcccgtcgactgattctctaggtagaaggagagcgggtagttcgtggctatgctcttcatgcctgtaagattgaaggtcagaccattcggattctccgtcggttccgccggtttgaggtagatgtagccagacggagattccggccatgtgagttggacaaggcccttcacggtgccgccgccttcggggtggatggcctgctcggcggctgtcagcgccaaggtgttatccgggtcggcgggcgtcgggatgaggcaggtggctcccgtctctacccggagcgcgtgggttccggacaggcgggggctgtgggtgttgttttggagcctcaccgtcccgctcgctaccgtgagggccgtgcccgtcgggggctggaaatctaccttgtccagcgtaagcgtagcctcgccctcggcatggatggtggcggggatgttgatgtaggatgagctgccgtttgtcgtcaccgtcccgtcgaacatcttctcgtcgcagtaccatccgtccgcggggtcgaagaagaggtcgatgccggtgcgggtgctgccgtagccgtagtccttggaaaggtcgagcggctgcggggtggggcgggtggcggtggcgccggagtatcggcagtatgccccgtctgtccggaagaaggggtagtctccgtctttataggaagacccgctgtaacgcctgccggcatatagccgctcgccgtcgagggaggcggtataccgcgtatcggccgcggcgaggaaggcgtaaccccagcaggtcccgtcggtcgcgaaggtggccgccggctcgtcgtcgcctgccggggtgacggacagcgtccggccatcggtcggggcggtatcgaaatccagttcgataaagccgcttacataggtgcagagcgcgttcgcttgcaggtggatccgtgcgttatccccgaacgtgatcgcgtccggcgaggtattgtcgtttttaaaggctgagccacctgttttactgatgacatgtatctctccgtccagatgcatccgggcattctggaagttggagatggcgccgatgctgagcggcgcttgggcatagaccgtgagcgtacccgtgcccgcgggagatccgtttaggataccttggcttatctcctgcgcatcggctacggtcagggtgagcgtgcctaagttatagatgaggtcgctcatgatctcgatccggttctccccctcgatccggagggtcggttccgcgccggccttgatatagaagagctggttgaaacttgaggttatgacggcgtctttcagcgtcagcgccggtgggttgccgctgtcgggatcggcggaggtgagtacgctgtcggaatcggtggaggggtgtatgacgaactgccggcctacctcgggcatcgtgccggtgatggtaccgttgaagggggtgccggtggtcggggcctgcgtgtcggatgcccctactttgtacacccacgtgccgtttaggtacgcgaggttgatgtaccagttattgttcagggtgcccggcagggtggcaaggtcgagtgccccgggaggttccgcttgcgcgcgggccgctgtcgggagggtggcgatcagtgtcgcgacactgatcagcaaggcgaatattcgccttgccggtaggtggatgtcatgtaatgatgttctcatgttctatgtgtataatagggtttataaatcggttgttttttccggcaggtccggtagcccctgtccggcaggcttggcagccgttgtcctcgatgcttggcagccgttgtccggacatgccggacaacgttgtcctcagatctcgtccggactctcgctgtcgcccccaccgccttctcctacgataaggatgatggggaaggtgtaggtgcggggctcttttacgttacggcttccgctgtattgcgtggtgaggctcacggtgtactgcccgtcggccagcgtcggcatctgcacgatcacctgcgagggcgagttggcgatcaccacgggtgccttcatcggcgcggccccttcggtggtgggggtgaggtagacaccgatggagggatcatcaccctgtatcttcaggttcacgccacccagcacgagggctccgccggagctgagctgcccgttgatggccttggaggtggagtcggtcacggtattgatcaccggacctacggccgccacgccgttcaccaccaccttcaccagcttgagggtctcgcgcaagagcttgcccatggtgtaggtgatgccgagggcgtgcttcccgggttcgaactgcgccttctcgccctcgaaggccccctgcacgttgacgaggtattggcccacgccgtccaccacgctcttgccctcggcgatggcctgcaccttatggctgtcggccatgtcgaggatgttgaggatcgtgccgtgttggtactcggtacgcgcggccacgatgcgggcggcgatgtccgtgttatacaatgtcccggtgatgtgcggcttggcggtgtagtcgcccttgcgctcggtgagcaggttatcgtacaagtctgtgttgagaatgatttgttctgccatggtattcctttattaagtgattactgccagcaaagaacggggttcggggtaagaatgagaggacaaatccgggaaaaaagaggacagatctcggaaaaatgctcattattgcgcctgccgccggtattgggcgggggtgactcccagtattttctggaagatacgcgagaaggtgcgggagctggtgaagcccgcgccgacagcgatctcttccatgctccggctgtcgcccggcatcaacagctcggtacgggcgtggttcacccggtagcggtcgatgtattccttgagcgtgatgttcagcttgtccttgatggaggtggagagatacttctcgttggtaccgagggcacgtactaggtcttgccggctgaaattcgggttgaggaagggtgaggagctggccatatagttttgcgcttgctggaacaactcgtcctcctcgatttccagcaacccgccgataagatcctctaggtccatccggttgggatcggtatcggcgtcggcttgcggggcgaggttgagccgtaggtatagttggtcgtacgtgtaatggtagttggcgtagtggatcgataccgaggcgtagaagagggcgaacacgaagttgaccgccgtgttatagtaattattcgggaagaaacagaggctcacggcggcgatgccgatacccagcgcccataggaaggcacgggttacccagcgcaattccagtcgctcgggtgattggggtatctgtttcaggttacctagatagatcgcccgctcccggaagaaaaaatgcgtatagccccctagctggacaaggtatacgaggcacgtgagcgtacgtatcagcaggggcgggttcccaatattatcccaccatacgtcgaaacgatacgtatggacatcctcccggaagagacaagcgatcgtgtaggctacggtaagcgcgatcgtaggcatggcgtggaggaggatattcctccgggtcacgttctttcccctgaataagagggtgagcaggaacgtgaacagcaacgcttgcgaggcgctgattagcaggatggggaagtagaacaactccatgatggttcgctcgtccgtgccggaagacaagatgaagatatgccctatgcctaccaatgccgaggccaaggcgagatacttgcaggccgtccggtacttggggatcgtgctttcccgcaaggtcttcagcgacaacagcagtccgctgaccagaaggcaggtaaaggctacgatccctgtcgaggctaagtagagtaggtggtcgttcatgttggttcgctattgttttttcaagtccggatagctgattcgggtatggaacatggttttcagtttgtctacgaatacgctctttatggtctccacgtccttgaaggtcaggggagcgctctttagcaagccgtcggcgatctgcccgtcgatgatcttgttcaccaaggcgctgatactctcttcggtatgttccttcaagctgcgggaggcggcttccacggaatcggccatcatcagtacggcggtctccttcgagaagggattcgggccggggtaggtgaatagctcgtcgttaatcggcttgtccgggtattggttcttgaaagagttgtaaaaatacttcgccttgccacgtccgtggtgcgtacggatgaagctgataaccgccttgggtaacagggccttctcggcgatcttcacgccctcggtgacgtggctgatgatgatctgcgcgctttggtcgaacgataactggttatgcgggttcacgctcgattggttctcggtgaagaagacggggttgctcatcttcccgatgtcgtgataaagggcgccggtacgtaccagttgggcgttggcgccgatcttggcggccgcctcggaagcgaggatggatacctgcaaggagtgctggaacgtgcccgggcaagtctcgctaagcttcttcaagatcgggttgttgatgttggacagttccaccagcgtgatgctggacacgtatccgaacgtcttctccaacatatataccaatacgtaggtgaacatcagcaggatgaagttgataccgaaataaagcatcatcatccagttgatcttgtttaagttcgcctcttgatacaacgtgagactgaggtagcaggcggcgtaggagatgaagatgaagacggcgcaacggatcagttgcgaacgttcgctcaactccttcaagctgaacgtcactaccatacccgccacgatttgcaacaacaggaactcatgcgggaaaggtaccatcaacgagcagatcagcacgatgataaggtgcgtgaaaagcgccgtccgggaatcgaagaaggtacgtactacgatcggtacgatggcgaacggcaatatatatacgttgaataatgcgtaggtaacacatagttccgtaaggatgcaactcacgaatatgcagaggatcaagaatagtacgttcttccggttatggaatatcttcaagcggaaagaccataggtagagccagaaacagaacattagcccgaagacgagcacgaattgtccggccaatatgatgccttgcgtctgcgtgccccccgtcttggcctcgtgtatggcctttagggaacggagcacgttgtaggtatggttgtcgatgatctcgccccggtctacgatacgctctccggcttgtaccataccgttagcgatagatacgctctgtagcatatcctccttgatcttgtcggacatgtcggcggcataggatatgttctcggtgaggtagttattgatgtcacacgattgcaggatcgatttgtccagccgcggcgggcagttgttgataatgaactcgtaggcggtgcgcacggtgaagaagtcgctcacgtagcgaggctgtgcgacggcgttctccaagaggttgacacgggagtattcctctttccgtagctcgtccagatcctgcgacgagatgataccgttcttgtataagttgatcaggctgctctctatatactgcatgtaagcgggggatactttgcttcgcaagttattgccgttattgtagttggcacgcagtttctcgacctcttgcttctggatgtcggggttcatgcggtaataaggctcgaacttacggagtacgctgtctttctccgcttttacctcgtcgtcggtcttgtagatcgggaaatcgctcggggcggtgagtaatccatatctccaaggcttgccctcatagaactgataacggaattttccctcccgagggaagaagtaggcgataagtaatgcggtcaccacgaagtagaccacggtcggtatattgtaattcttctgtttcatatagattcctttttgcgtccgaaatatacgtaaaaaacttcactaagcggaaaaaaaggcgtacttttgccgcattattatagaatgtaagtattatgactcaaagaaaagtaagagtacgcttcgcacctagtcctacgggggcgctgcatatcggaggtgtccgcacggctttatacaactatttattcgctaaacagaatggcggtgatatgattctccgtatcgaggatacggattcccaacgcttcgttcccggggcggaagactatatcatcgaggccttgacttggctgggtatcaagttcgacgagggcgtgagcttcggcggcaactacggtccgtatcgccagagcgagcgtcgtgagatctacaagaagtatgtcgatcaattgctgaacgatggccatgcttatatagcgttcgatacgcctgccgagttggaggagaaacggaaggagatcgccaatttccaatacgacgcctctacccgttcgcaaatgcgcaactcgttgacgctttctcaggaagaggttcagagcctgatcgagtcaggtcatcagtacgtagttcgtgccaagatcgagccgaatgaggatatccacgtgaacgacttgatccgtggcgaggtcgttatcaactcctctatcttggatgataaggtattatataaatcggccgaccaattgcctacttaccacttggcgaatatcgttgacgaccatttgatggaggttacccatgtgatccgtggtgaggagtggttgccgagcgcaccgcttcacgtattattatatcgtttcttcggttgggaagatacgatgcctagtttcgcccatctgtcgttgctgttgaaaccggaaggtaacggtaagttgagcaagcgtgacggcgatcgtctgggcttccctgtattccccttggaatggcacgatccgaagacgggtgatgtttcatcgggctatcgtgagagtggctacttccccgaggctgtcgtaaacttcctcgctttgctgggctggaacccgggtaacgatcaggaggtgatgagcatggatgatttgatccgtttgttcgacctgtctcgttgcagcaagagcggcgctaagttcgattatgagaaaggcagatggtttaaccaccactatttgctggagaagagtaatgcggagatcgccgacctattcttgccgatcgtggaaagccatggtatccagactacccatgcttatgtagagaaagtggtcggcatgatgaaaggccgtgtcaatttcgtgagtgagttatgggatctttgctctttcttctttatcgccccgacggagtacgatgagaagactcgcaagaaacgctggaaggaagattcggctgttcaattgggtgagtttatcgagcaattgcgtgcccgtgagccgttcgacgtagaaggtaccgagaacgagtgcaaggcttggatcgagagcaagggatatcatttggggaatatcatgaacgccgcccgtctggccttggttggcgagggcaagggccccggcatctttgatattaccgaggctttaggtaaagaggagtctatccgccgtatccaacgggctatcgagatattaaaataatcatgtacagtttagcaatacatctctacgcttttgtagtcgctttgatctcgcctttccataaaaaggcgagactgatgcgattcgggcaatggaaaacaaattccatacttcgtgagaaaatcgaccggaacgctaaatacatctggttccatgcctcctcgctgggcgagttcgagcaagggcgtcctatgatcgagaagatcaaggcggaacatccggagtataaggtgctgctgactttcttttctccatctggctatgaggtacggaagaattacaagggagcggacgtgatctgctaccttccttttgatacgcctttccgggtgaagaagttcctgaatctggcgaatccggcgatcgccatatttatcaagtacgagttttgggggaactatttgcgtgagttgcggaagcggggaataccggtttatatcatttccgctatattccgccccgaccagctatttttccaatggttcggaaagccgtaccggaagatgctatcttattttaatcatctttttgttcaggacgagcgttcgatgaaactcttgaacgagttcggcatcacgaatgtgacggtgaccggcgatacccgttttgatcgggtgttggatgtccgtaagcaagctcgtgagcttccgtttatcgaacgtttcttggaaagcaaggaaggtaagaggccgatcgtgatggtggccggcagttcatggcctcaagacgaggcgatctttatcccttatttccatgagcatccggagatgaagttgattatcgccccgcatgagattcaccgggaacatctcctttctatcgaggcgatgctaaaacgtccgtccgtccgtctatcggaggcgcatgaggatgatctggccgataaggattgcttgatcatcgacagtttcggactcttatcttccatttatcgctatggacagatcgcttatatcggtggtggtttcggagcgggtatccacaacacgttggaagccgccgtttatgggatgccggtcttattcggtccgagataccataagtttaaggaggcgaaggatctgatcgccgtaggtggtggtttctccatcacagacgattcctctttccgaacgaagatggacgagttattgaccgacccgacagccttggaaacctccgggcaagctgccggtgattttgtgaaaaacagtgtaggagcgacggatcaaatcttgcgacaaatccatatccgttaatagataaagccgggtttgctattcgagtgattgtatgcccagattcttttgatatagcaatggaatacggatgagatagatgtacggattggtaattgaacgatttgcgttgtctatctcatccgtgttttattttaatcctcttcagcgaacatcgggtcccaagcgggaaggcgagtcggtgtttgtttcaagatctcttttacttgatccgtgatgtacttcttgttgactaccagacggaacatatactcattaaaccattggtctgtcatgatgaggtggccggcgttcgctccggggccccaactattctcaaccatccatttcttcggctttccattcgcgtcgaggtcaacagccatcaaggtcatggcgtgtgaggaaccgctggcgaatgtctggatacgttgtttcttatccatgccgaaagtcgtacccatcagtgaaccgtaatcgtagaagtttacatccagaatacctctgtcacgatcgaagaacttgcccacgtcgcaagagaaatacatcatggtgctgtccttgatggaagcgatagccatttgtttgatatcctcgatcggaaggtttacgtaagtccagttctttccatcgtaagcgtggcggtcgtaatcgatctcatacaacttataataatcgcggctcggatcgttcatcaacatgacatagttgtttttcaaatcgtccccgatatattcttggaagaaggactgaggcgtatattccttcgtctctaccggattccctttagcgtctttgcgagtccacgtgaatttcgtaggcggctctcccaagttcaatacgagcatacggtaaatcgtacctagcatctcggtcttctttttctccagatccgctacggtcgtgcctttggtcgtagacaggtcacgaagttgcaagccgtattctttcagctttaatccgatcaggttgctcatgcgtccggtactgttgctactgttggtctctaccatgacctcggcgggaaccacgccatacttggtcaagatatcggagacacccgtgaactgccctccgtctccgatcgggttcttgaacagccattccaccatcttgtcgtccatcggtttcagacgagtatcgatgatgccctgtaagaaaaggttcgctttctccaattgatcccagaagaaagaataattctgggagaattgaaagtctcccatgtcatatttggcgatggcctgcgcacggaacacgttcaatcccgtgaaaagccagcaacggcccgaggaacgttggttggagatccctttgctctctaccttattggagaagtaagtatccaaattgttcttgctctccccattaacggcaagcttgttgatgtcgttattggtgatcgcgttacggatcgccttatcggtcggcgttccttgataagactgtttgatttgctgcaacatcgtgggtgagatgcctccaccactttgttgtccgtgagccgatagcgtgatgcctaaagccaaggccgctatccataaattcttttgcttcatgatattttagttgattaataaattgtgttatttctttttaggccataccagaccgtcttgccggatattccataccgtaccgtctggtgcgggtagtgatatctcatacatggaaggtgtcgtatgtatttccagttgattggcgatctcttgcgggcatagctcgtttgccttcaagtcgttgatgttatcggcataatgtccgaaggtcgcggcgaactcattctgacggtaatataaattacgcaagatccatttcgtctcctccgaaggatgttttacgaaaggagtctcaccttctcccgcaatcttatccgatatttgaacataaccccagtattcgggcatatggatattgattaccccggtaggcgcccatacccagttgtactcgcgaatcttatcctctccttggatagggactttcacgtatttaccgtctttcaggtccgttgtccattccacacgagagaagttcacacggatctgctcgccgatttccggcttttcttttcctctgtccatttggaatacggaagtccaaggaatgaatacctctacgctccatgatttatccgtgtctttcgggttattcagcgtaccgtccacataaacagcggatttcattccggtaaactcccagttattcaatacttgcggattatcccgataggggcgggttaagaacaagtcccattccgtacccaaggcgttcacctcgtactccagataattatgggtgtcgttcgtaggattcaggaagatctcgaagtcgttgtcgtggaagatcacggcgtcgtgttccgtgatggtcgcccatacgtgcggctcctccataaggacggcgaagtacattccgttatcatcgtaagtcatcttggcccgggtctggaagtgaggggctgggcgtttgtcgccttcgatatctacgaagtcgctggtccaaggtatcgcgtcccattccccgggagaaagctttccgtcgatcttgataggagcgggggccttgtagcaaacatacgtcggcggattgaacggtggttgcggcatatacgtgatgtctggcttttgcgtactgggtttctgtgcgcaagaaagcaataggagtgccgccaatggcgctgtcgttaaaatcgtttttctcatgtgcgtttatttttagatcgtttgataaatagattcttattgaagtaagtccatcgccgcgtccaaccatgtatttatatcgtccggataatgttgatcggcggtataagtatcgctgcgtttgtgcccgagtcttacgatcacggcgttcttttccgggagcgtgaagacgtattgccccaagattcctctcatataagggatcttcatccctttgtaatcgagaatccagtattggaatccgtaacaatggttgggtttgccgagatccttatagacaagacgggtatcggggcttgtcgcttccgccagataagcgggagagatcaattgccggtcatcccattgaccgttgttgagtaataattgtccgaagcgggcgaaatcacgggcgttactgttgaaacagcaataggctttttccatgccgtccttccggtcgaggctccaaagggcgctttcctcggcgtgcatcggagtccatagtttgcgggatacataatcgctgagtttctccccggtagccttctccacgataaagcccagcagttgtgtcacgccgctttggtagataaagtttacgccgggctcgtcgatctctttcatcccgaaggcgatttcctgtaggtcatcgccataatacaactgggtggtaggagagaaaggagagctgtaagcctcgtcgaaatccacgccggcgctcatggtcagcaaatggcgaagcgttagggcctttccgtcgtatcccttgaattccgggaaaaagtcgcttaccggttgatcgacattgcggataaatccatcgtcgatagcacagccgatcgctaacgagacgatgcttttcgccatcgagaaggaattgctatgcgattccggggaataatcttcccaatattgctcgaatagcagtcgattgtcttggatgattacataggcaaccgtacccagctcctcaaaccggggaagataacgctctggaatacttttcgtattgtaagcttccgatagttcccaagggcggggcgaacctgcttttacgacccggttctcgaaaatcggatattgatcgatcttgggtaacaaatggataagggccctacgtagataataattggagggtaacgccagatatccgcctattcccagcataaaaataaacactatccatcccactcttcgggacaaatagtgtttattggctggaaccctattatttgaatcatttttcatgtaaccctttggttgttactttacagatacaaatatatggtttataattcaaataatcaaatacatgctattattctttataccaagaagaatacatatgatagttcttggctatcttttggttgatctccttcgcttgctcgggatctaccttcttgacgaacttagcgggaactccggcgtagatgctgcccggctcgacgatcgtcttgcttaatactacggaacctgcggcgatgatcgctccctcgcctactacggcgtgatccaataccacggagcccattccgatcaaggcgccattgcaaatcttcgccccgtggatcgttacgttatggccgatggatacatcatcgccgatctcgatcgtcgatttctcatataaggtgtgaaggacggaaccatcctgtacgtttacgccgttgccgatgcgaatcgagttcacgtcgccgcgaagcacggtgccaaaccagatactgcaaccttcaccgatctctacgtcacctataatcgtggcgttgtctgctaaaaaagtgtctttaccgatcttcggggtaaagccacgaacggatttaattaatgccatttttagttgtttaaatttctgttgttttctctttcagccaagctttctcctcctcgttcaagaacgggctgatcttgtcgtagaccatttggtggtacttgttcagccaagcgtgctcacggacagagagcatggggatgataatcaagctcgtgtcgatgaaacaaagcgtcagcgtatcgaatcctaggaatttcccgaattccgtttcgctgtcctcacgtaccaagatcatgttctccgtacggataccgtattcgccggtacgatacatggccggctcgtcgctgatcaccattccgggcttcaaggtcaccgggttctcctccatgcggatgctttgggggccttcgtgtacgtttaggcaatggccgataccgtgaccggttccgtgcaagtaattaatgccggaatcccatagcgccttacgggcaaggatatcgatctgagagcctcgtgttccagcgggaaacttgcttttcgccaagctgatcgtacctttcaatacacgggtgaaatcctttttcatctgctccgtcggctctccaagggcgatcgtgcgggtgatatccgtcgtaccgtccagatattgcgcaccggaatcgatcaaaagcaatccctccggtttcaaggtcgcgtccgtctccggcgtagcggaataatgaacgatcgctccatgctcggcgtaaccgcagatcgtgccgaagctatccatgatgtattgcggttgttccgcacgtaaggctgtcagcttctcggcggcgctgatctctgtaacttgggctccttccgccatttttttctccagccagatatagaattttgtcaaggcgacgccatcttttaccacggcgttttggaatcccttgatctcggtctcgttcttgatgctcttcaagtgattggcgggggagatcccttccacgatcgtacagcttcccgggatcgcatcgtataaggagacgttcgtcttgttcatatccacgaatacccggctgttttccggtaggcgggacagatacctctggatcatggagtattcggccagcgtaaccccttctttcttcaaatgctcggtgatctcggcggtcagcttctccggcttgatgaaaagcacgctctcgtcctccgatacgaaggcgtagctgactacgaccgggttataggtcacgtccgtaccccggatattgaatgtccacgcgatctcgtccaaggcggcgaggatcaagcaatcggcgccctcgctccgcaactggttattgattaggtctagtttctcgtgcacggaggctccgcttaatgcttccggcatctcgaatatcgggtttccgggaacggcgggacggtccttccagataccctcgatcaggtcggccgaggtatccagcttgatttctttacggcttagtttatttgccaaggcactcgcttcggcggcgctataggtttgcccgtccagccctacggcctgtccggcgtgtaactcatgcaagaggaattccgtgatagacggtgtctccggaagcgccaacttatagagttcgataccggaaccttccagttggctggccgcttgcaggaaataccgggaatcggtccataagcccgccttgtccgcggtgaccacgatcgttcccgccgagccggtgaagccggatatccattctctcgatttccagcgatcggccggatactcgcttagatgcgggtcggaactgggtatgatataagcgtcaaccttctgttgtctcatagcctcccgtagggcggcgatacgttcaggaatgtttgttttcatcgcattttattttagtcaacattaatactcgcaaagttaatgaattattttggatttgtctcgccggaaaccggctcttctaccttataatatagatgggaagtacctagcttttcccaccgcagtttcctttcctctaccagccgccgcaagtcgagggaagccttacttctggagcatccgcagagcgacatatacttcttctggtggataaaagggttcgtctccagataacggaatacctcttgctcgcattccttggcggagggatacgcaggatcgctaaccgtgtactcgtcacgaaacaccggcatggtcttcagccggtctcttagttccttggacgatctgaacttcacgtccttgaaatggatggattccgcccggatctcattcttttccatcacgggccggcttttcagtgagacgctgaaagtaccgatcccctctagctccacgttataaccgaacatgaggaagtccaccatcatgtcttggaaaagctgcaagatccctttcatatccgcgggcgagaaagaagaccgggacttcgctctattgatgaactcatccgtatgtatcgtcccgcaagagaccaaacgaggatgtaggggtaatgacttcccggattcctctggattcgggttggggtttctgactagcttgtaatttgctgacatctgtgctgtgtttaaatggttatagatcttttgtctgattcttctggatcgcttacccgtttctataggcgagcttagcggtttcttcaagaaggattcatcttccaacagccgttgcatgatcatgcaccaactgttggacgatcatctaccatctgttggatgattgtccaacggatggtagatgatgaatacttcagcttcaaaggtacaacatataaaggagaaaagggttaggatttcagataaaagagctaaaggttatgataaacgtgtatgggctcacaaccttgtgaaccgatccctttaaatcaagttaaagataaggcacccaatagatatcaaggaataatttgctagctttgtagaaacaaataagaagtgccatgaggaatctgctttatctttttgtctttgcggctctgcttctcggcttgagcgcatgttcttcttattattattcgatgttgaactcgaatgaccccgtcggggagaagaatgagagaggtgattttgtgcaggaaaacgatacggtacgtatctcttatcgtttctggggagagaacgccccggttactattaccatttataataaattgaatgaacccttgtatgtggattgggggcggtcggcgctgattatcgatgacgtggctaccacctacgacccgaaagtggcctcggtgagaggcgagagctctagcgtggcatccggtagctcctttcattggagcgataggagcagcagcgggtggagctactcggaaggttccttctccggtgatgtgagtttgccaaagggcgttgagtttatcccgccgcattccaaattagtcaatacgcctttgcaattagccaacttcccgtttaacgagatcccgaaagaagagtatgtaaaggaacaaatgacaacgaaagcaaacacaaccgtaaatatccgagtgaaggattttacagaagaagattctccgctgagattccgtagctacctgacgttgttcgccggagggactaatgggaagcccttgaagcattcctcttttgagcggaacttctatctggcgaaattgatcaaggtcggcgacgtggctccccagtatttcgatgagggacagcagcaatccggcgatttcttttacgtgaaagagactcatggggctacggcaggccttgtcgtaggagcgatagcggttaccgccgcaggggtggcgatagaagctacgctgggtcccgtgaactattaatatattcatatcgaatgatacaaactctatctgatttaaagaccgtgcgtttcaacgagcaagcggacggtgtgatcattttggaccaaactctgctgccgggtaaggaagcgtatctgacccttaccactgccgaggagatatgggatgccatctataaattaaaggtacgtggagcacctgctatcgggatagcggccgcttatggtatctatgtctgcgcccgtcggatcgatacggcggagaaatccgttttcgtggatgagtttcggaagatcaaggagtatctggccggttcccgtccgacggcggtgaatctagtgacggcgctgaaccggatggagcgggtattggtcgctcatccaaccttgtctgtcccggaatggaaagagctattatataaggaagcgatcgcgatccgggaggaagacgccgccgcttgccggcagatcggcgagaactgtctggagctactccgtcccgggatgggaatccttacgcattgcaacgccggacatctggcggtctcggagtatggcaccgccttggcgccgatttatctggggcaggagagaggctatggtttcaaggtcttcgccgacgagacccgtcctttgttgcaaggcgcccggctcacggcctatgagctaagcagggccggcgtggacgtgacgctgatttgcgataatatggcctctatcgtcatgcggaaaggctgggtgcaagccgtggtcgtaggttgcgaccgtgtagccgccaatggcgacgtggcgaataagatcggcacgtccggagtggctatcttggcccggcattacaagatccccttctatgtattaggcccgacatccaccatcgatagctcgtgcccggacggcgattccattgtaatagaggaacgtaaccccgatgaggtcaccgagatgtggtattcaaggcgtatggccccgaaagacgtaaaagtctacaaccccgccttcgacattactccccacgagctaatcacggctataattacggagaaaggcatcttttataaaaataatcgctgaaagttttgctaatcccgaaacaatcagtaattttgccgctcaatttgaggatataaataattaaacaatataacaatttaaattatgatcgtagttccattaaaagaaggcgaaaacatcgagaaggcgcttaagaaattcaagagaaagttcgagaaaacaggtgtagtcaaggaattgagaggccgtcaggctttcgagaaaccgtctgttacgaagagaaagcagactatgcgtgctatctacgtacagcatttgcaacaagtagaagaataattatagcttccgggcttgttttattgaattcttattcctattttcgttgcatgaatgttgatgcaacgaaaatatgctgatcgatgactttctaaactatctccggtatgagcggaactattccaattatacgattggtgcctattcgaaagatttggaccaattccagaggtatgtaagagagcatcgagaaggtgtattcaaccccggggaaatcgactcggatttcgtgagaagctggatcgtcagtttgatggacgagaagctttctcccgtatcggtaaaccggaaattaagttctttgaaatctttttttaagtttctcatgaaacgggggattgtctccgcgaatccgttgagattggtgagcggtccgaaaacgaagaaacccttgccttattttattaaggatagcgagttggaggcgttgttggacggggacggatttgatgaggattttgaaggtgtgaggaatcggttggtcattgagatgctatacgataccgggatgcgccgctcagagttaatcggcatacgaaacgtggatgtggattatgaggcgatgcaggtcaaggtaaccggaaagcggaacaagcagcggttgattccttttgcggagggtttaaaaaacttaatgcttgcatacacggaagtccgtgatcgtgaggttgaggcagccggtgaatggtttttcgttcgaaagaacgggaatcagttgtcgacggggattgtttataatatagtaaaaaagcaattgtcggagatacccatgctggcgaaacgaagtccacacgtgttacgacattcatttgcaacgagtatgttaaacaacggagccgagctgaacactgtgaaagatttattaggtcatagcagtttagcgtctaccagtgtttacacgcatacaacctttgaggaattaaaaaaagtgtatcatgctcatccaagagcaaaaaaagaaggaggttattatggacgttagaattcaagcaattcatttcgacgcaactgcacagttggaggcgtttattcagaagaaagtttctaaattggagcaatacttcgatggtattatattggcagaggttacattgaaggtggttaagcctgagacggtgaagaacaagcaggccagtataatgttgtccgtgaagaacggggaatgtttcgctgataaaataaacgatactttcgaaggggcgatagacgattgtgttgaggctttggagaagcaactggttaaattcaaagaaaaaatcagagccaaataaaaaaaacggtagataaatttggtatgtaagaaataatatctaaatttgcagccgtttcgccgtggtgacgaaacggctgcttttagaagtatcgcctctttagctcagttggccagagcacgtgatttgtaatctcggggtcgttggttcgaatccgacaagaggctcaaaagaatgtattggaatgggcagttaccagagtggccaaatggggctgactgtaactcagctggctttcgccttcggtggttcgaatccatcactgcccacacgaatgaaacaaaggagagaatcggttggttcattcggtcttgcggaagtagctcagttgatagagcattagccttccaagctgagggtcgcgggtttgagccccgtcttccgctcttataagttgcctgtgtagctcagcggtagagcacttccttggtaaggaagaggtcccgagttcaagtctcggcaccggctcaattgaaaattgaacatgatcattaatcaaataaagaacaattaagttatggcaaaagagaaatttgacagatcgaaaccacatgtgaacattggtacgattggtcacgttgaccacggtaaaacaactttgacagctgctatcacaacagtattggcaaagaaaggtctttcagagttgcgttcattcgattctatcgacaacgctcctgaagaaaaagagagaggtatcacaatcaacacttctcacgtagagtatcagactgcaaaccgtcactatgctcacgtagactgtccgggtcacgccgactacgtaaagaacatggtaactggtgctgctcagatggacggtgctatcatcgtagttgctgctactgatggtcctatgcctcaaactcgcgagcacatccttttggctcgtcaggtaaacgttccgagattggttgtattcatgaacaagtgtgacatggttgacgacgaggaaatgttggaattggttgagatggagatgagagagttgctttcattctatcaattcgacggtgacaacactccgatcatccgtggttctgctcttggtgcattgaacggtgatgctcaatgggaagataaagtaatggagttgatggaagcttgtgatacttggattcctctgcctccgcgcgaaatcgacaagccgttcttgatgccggttgaggacgtattctcaatcacgggtcgtggtactgttgctacaggtcgtatcgagacaggtattgttaaggttggtgaggaagttcagatcatcggtcttggcgctgctggtaagaaatctgttgttacaggtgttgagatgttccgtaagttattggatcaaggtgaggctggtgataacgttggtttgttgcttcgcggtatcgataagaatgagatcaagcgtggtatggtaatctgccacccgggtcaggttaaagagcattctaagttcaaggctgaggtttatatcttgaagaaagaggaaggtggtcgtcacactccgttccacaacaaatatcgtcctcagttctatatccgtacattggatgtaactggtgagatcactttgccggaaggaactgaaatggtaatgccgggtgataacgtaacgatcgaggttgagttgatctatccggtagcatgtagcgtaggtcttcgtttcgctatccgcgagggtggacgtacagtaggtgcaggccagatcacagaattagagaactaattcaagcattagataatgttatagccagtctttttaagggctggctatttctacggaagtagctcagttggtagagcactggtctccaaaaccaggtgtcgggagttcgagcctctccttccgtgctaaaatctatagattcgatgaaaaagataattacttatattaaggaatcttataacgaacttgtttataaagtttcttggcctacgagagcagagctttccaatagtgcggttgttgttatgtttgcttcccttatcatcgccgcattgatctttgttgttgacggggccttcgaggctgttatgcgtttcttctacaaccaaattttctaatcagttaaggtatgtctgatatccaaaagaaattttatgttctgcgtgccatcagtggcaaggagaacaaggtacgggaatatctagaggctgagctgaagaatacggatctgggagaatatgtatctcaagtcttgattccgactgagaaaacctttacggtacgaaacggtaagaaggtcatgaaagaaagggcttacttgccgggttatgtgctggtcgaggctgctttggtcggtgaggttgctcatcgattgcggaacattccgaatgtgattggtttcttgggtggttctgatacccccgtgccattacgtcctgcggaagtgaatcgtatcttaggtacggttgacgagttgcaggaacaacaagaggatctggatatccagttctatgttggcgagagtgtgaagattacttttggaccgttcagcggtttcacgggtataatcgaagaggtcaacgccgagaaaaagaaacttaaggtgatggttaaggtcttcggacgcaagactccccttgagttgggttatatgcaagttgagaaagaatagtactctggttacgaaaagtgctacctttctgttattgatgttatatatctaaaaaattttagaaacaatggctaaagaagttgctggacaaatcaaattgcagattaaaggaggagcagcaaacccttctcccccagtaggacctgctttgggttctaagggtattaacattatggagttttgcaagcaatttaatgccaagacccaagacaaggctggtaagatattacctgttgtaattacttactatgccgataagtctttcgactttgtcgttaaaactcctcctgtggcaatccagttgttggaagctactaagaagaagagcggttccgctcaacctaaccgtgctaagatcgctgagatcacatgggagcaggtgaaagctatcgctgaagacaaattagtcgatctaaactgctttactgtcgagtcggccatgagaatggttgcgggaacagccagaagtatgggtatcactgttaaagggacattcccgggtaataattaataaacttcaattgagatgagtaaacttacaaagaatcaaaagttggctttgggcaagattgaagctgggaaagcatatacattgaaagaagcttcagctttagtgaaggaaattactacaactaagtttgacgcatccgtagatgttgatgtccgtttaggtgttgacccccgtaaggccaatcaaatggtgagaggcgtggtttcattgcctcacggaactggtaagcaggttagggttctcgcattatgtactccggacaaggaagctgaagctactgccgctggagctgactatgttggattggatgagtatattaataagattaaaggcggttggactgaaattgatgttatcatcactatgccttctatcatgggtaagatcggtgctcttggtcgcgtattaggccctcgtggtttgatgcctaacccaaagagtggtacggttaccaatgagatcggaaatgcggtgaaggaggttaagcaaggtaagatcgactttaaggtagataagagcggtatcgttcacacatctgttggtaaggtgtctttcactccggaacagattcgtgacaatgctaaggagtttatttcaactttgatcaagttgaaacctactgcggctaaaggtgcgtatataaagagtatttatctttctagtactatgagtgcgggtattaaaattgaccccaaatcagttgaagaaaactaaaaaacaattgaacaatgagaaaggaagataaaggaactgttataggtcaattaactgaaacattaaaggaatatcctaatttctatttgacggatatcgaggcgttggacgctgagaaaaccagcaaattgagaagagagtgtttcaagcgtgaggttaagttagtcgttgtaaagaataacttgcttaagaaagcgttggagaacattgaaggtgacttctctgatcttaacgtagctttgaaaggcaatacggctgtgatgttctcacaagtcgctaatgctcccgctcgcctgattaaggattttactaaggacgctaaaaaaggtgtagtcgctaaaccggctttgaaggctgcttacgtacaagaaagcttctatgtaggtgctgagaatcttgaggcattagtaaatatcaagagcaaaaacgaacttattgccgatgttatcgcattgttggaatctccggcgaagaacgttatctctgctcttcagtcatcaggacaaactatccatggtctgttgaagactttggaagaaagataatttttcattaaaacattacacagataaataatcatttaaatcatacaaaaatggcagatttgaaagcttttgcagaacaattagtaaacttgaccgttaaagaagttagcgaattagctactatccttaaagaagagtacggtatcgaacctgctgctgcagctgttgctgttgctggtcctgctgctggtggtgctgctgccgctgcagaagagaagacttctttcgatgttgtattgaaagcagctggtgctaataaattagctatcgttaagttagttaaagaattaacaggtcttggcttgaaagaggctaaggatatggtagatagcgctcctagtgcaattaaggaaggtatcgctaaagctgatgctgaggcattgaagaaacagttggaagaggctggagctgaagttgagcttaaatagtatttataacctggtttccaggtgatttggttaagagtctccgactacgaagactcttaacctttttgtgtctataatttcaataagttcaataaattccttactagatgtcttcaacagctgaaaaccaaagagttaattttgcttcgataaagaatcagttcccgtatccggactttctcgaagttcaattgaagtcgttccaagactttcttcaacttgacactcctcctgaaaagagaaagaaggagggattgtataaggtatttgccgagaatttcccgattgcggatacccgtaacaattttgtgttggagttcttagattactatatagatccgcctcgttactgtatcgatgagtgtatcgctcgcgggttaacctatagcgtgcctttaaaagcgaagttaaaactgtactgtacggacccggatcatgaggacttcgatacggtgatccaagatgtatacttaggtccgatcccgtatatgacggacagaggtactttcgtgatcaacggcgccgagcgtgttgtcgtgtctcagctgcaccgttctccgggcgtattcttcggacaaagcacgcacgcaaacggaacgaagttgtactccgcacgtattatcccgttcaaggggtcatggatcgagttcgctacggacatcaacaatgtgatgtacgcttacatcgaccgtaaaaagaaattgcctgtaactactcttttgagagctattggttttgaaagcgatagagatattcttgaaatcttcaaccttgcggaagaggtgaaggtaacgaaagcaaacctgaagaagtttatcggacgtaagctggccgctcgtgttttgaagacttgggtggaggatttcgtagatgaggataccggtgaggtggtttctattgaacgtaacgatgtaatcatcgaccgtgagtctgtattggatagtgacaatatcgaggctatcttggattcaggcacgcaaaatattttgttgcatcgtgaggaccagaatctgtccgactatgctatcatatataatacgctccagaaagacccgagtaactccgagaaggaagctgtgttgtatatctacagacagttgagaaatgcggaaccggctgatgaggctagcgcacgcgaggttatcacgaacctgttcttctcagagaaacgttatgatctgggtgaggtgggacgttacaggatcaacaagaagttaggccttactacaagcgctgatgttaaggtcttgactaaagaagatattatcgagatcatcaagtacctgatcgagttgatcaactcgaaggctatcgtggatgatatcgaccacttaagcaaccgtcgtgtacgtacggttggcgagcaattgtataaccagttcggtattggtttggctcgtatgtcacgtacagttcgtgaacgtatgaacgttcgcgataatgaggtgtttactccgattgatttgatcaatgcgaagacgatttcttccgtggttaactctttcttcggaacgaatgccttgtctcagttcatggaccagacgaacccgttggcggagatcacgcacaagcgtcgtttatcagccctaggtccgggaggtttgtctagagagcgtgccggattcgaggttcgtgacgttcactatacgcactatggtcgtctttgtccgattgagaccccggaaggtccgaacattggtttgatctcttctttatgtgtatacgctaagatcaacgatcttggtttcatctcgactccgtaccgtaaggtggcagatggaaaggtcgacttctctgaggaaggcttgcaatactacacggcggaggaagaggaagagttgacaatcgctcaaggtaacgctccattggatgataacggtaagtttatccgcgataaggtgaaggctcgtttcgaggctgacttccctgttgtccctccttctgagattgacttgatggacgtggctccgcagcagatcgcttctatcgcggcttcactgatcccgttcttggaacatgatgacgctaaccgtgcgttgatgggatctaacatgatgcgtcaggcggttcctttgttgcgtacggacgctccgatcgttggtaccggtatcgaggcgcaggttgctcgtgactctcgtactcagattatggctgagcgtgagggcgaggttgtgttcgttgatgctacttgtatcaagattaaatatgaccgcacggaggacgaggaattcgttagcttcgaggatgcggttaagacatataatatcccgaaatggcgtaagaccaaccaaagtacgacagtcgatttgaaaccgacctgtcatcgcggacaacgtgtgaaagccggcgatatccttaccgagggttactcaacccagaaaggcgagcttgccttgggacgtaacgtgaaggtggcttacatgccttggaagggttataactatgaggatgctatcgtgttgaacgagcgtatggttcgtgaggacttctttacgtctgtccacgttgacgaatacatccttgaggtacgtgagacgaagcgtggtatggaggaattgacttccgatatccctaacgtcagcgaagaggctaccaaggatttggatgagagaggtatcgttcgtgtaggtgctcgcatcgagccgggtgatatcttgatcggtaagatcactccgaaaggtgagtctgatccatctccggaggaaaagttgttgcgtgctatcttcggtgataaggcgggtgatgtgaaggatgcttccttgaaggctactccgtctttgcgcggtgtggttatcgagaccgctttgttctcgaaggctgtcaagaaacgtaaatccagattgactgataaggcgatcttgccgaagttggacgaggaatacgaagaaaagatggctagcttgaagactttgttagttgataagttgttagtgcttacaaacggcaaggtttctcaaggtgttaaagactatatgaatacggagattatcgctaagggtgctaagtttacccgcaaatctctggaagaattggattataactccatccaagtaagcaagtggacggcagacgctcagaagaatgagttgatcaagcaggttatcttgaattatttgaagaagtacaaggagcttgacgctgagttgagacgtaagaagttcgacttgacgatcggtgatgagctgccgacaggtatcgtacagatggctaaggtttatatcgccaagaaacgtaagattcaggtaggtgataagatggccggtcgccacggtaacaagggtatcgtatcaaagatcgttcgtcaggaggatatgccgttcttggaagacggtactccggtggatatctgcttgaacccgctgggtgtgccttctcgtatgaacttgggacagattttcgaggccgtgttgggttgggccggacgtgagttggacgttaagttcgctactccgatcttcgatggtgcgactttggatgatttgaacgaatggacagacaaagctggtattcctcgctacggtaagtcttacttgtatgatggtggtactggtgagcgtttcgaccaacctgctacggtgggtgtgacttacttcttgaagttgggccacatggttgacgataagatgcatgcccgttcaatcggtccgtactctttgattacgcaacagccgttaggtggtaaggcacagttcggtggtcagcgtttcggagagatggaggtttgggcactggaagccttcggtgccgctcatgttcttcaggaaattcttacgattaagtctgatgacgttgtaggacgttcgaaggcttatgaggcgatcgtgaagggtgatccgatgccacagccgggtatccctgaatctctgaatgtattattgcacgagttgagaggacttggtttgagtttcactctggattaattcaataacaataaagaagtaggtgggctacggcccgtctactttatctattgataactctttataaataaataatatggcctttagaaaagaaaacaagataaagagtaacttttcaaaaataaccatcggtctggcatcccctgaggagatcctagagaactccagcggtgaggttttgaaaccggaaacaattaactatcgtacgtataagcctgagcgtgacggtttgttctgtgagcgtatctttggtccgatcaaggactatgagtgccattgcggtaagtacaagcgtatccgttacaaaggtattgtctgcgatcgttgtggagtggaagttacggaaaagaaagttcgtcgtgaacgtatgggacacatccatttggtggttcctgttgcccatatttggtatttccgttctttgcctaataaaatcggttacttgctaggtcttcctaccaagaaactggattccatcatctattacgaacgctacgtcgtgatccagccgggttgcgtagacacggtcggtgagttagacctattatctgaggaggaatatctggatattttggatagccttccaagagaaaatcaattgctagaggatacggatccgaataagttcatcgctaagatcggcgctgaggctgtttatgatctgttggctcgcttggacttggattctctttcttatgagttgcgtcaccgtgcgagcacggacacatctcaacagagaaagaacgaggccttgaaacgccttcaggtagttgagtcttttcgtgcgtccagaggtcgtaacaaaccggaatggatgatcatgaaagtgatcccggtgatccctcccgaactgcgtccgttggttccgttggacggtggccgtttcgctacttctgacttgaatgatttatatcgtcgtgttattatccgtaataaccgtttgaaacgattgatcgatattaaggctccggaagtgatcttacgtaatgagaaacgtatgcttcaggaggccgtggactctttgtttgacaactctcgtaaatcgagcgctgttaagacagacgccaatcgtccgttgaagtccttgtccgacagtttgaaaggtaaacaaggtcgtttccgtcagaacttgttgggtaagcgtgttgactactccgctcgttcggttattgtcgtaggtccggaattaaagatgcacgagtgcggtttgccgaagaatatggctgccgagctttataagcctttcgttatccgtaaattgatcgaacgcggtatcgtgaagacggtgaaatctgccaagaagatcgttgaccgtaaggaaccggttgtttgggatattttggagtacgtaatgaaaggtcacccggtattattgaaccgtgccccgacattgcaccgtttgggtatccaagcgttccagccgaaattgatcgagggtaaggctatccagttgcacccgttggcatgtacggcattcaacgccgacttcgacggtgaccagatggctgttcacttgccgttaggtaatgaggctgttttggaagctcaaatgttgatgttggcttcacacaatatcttgaaccctgcgaatggtgctcctattaccgtaccttctcaggatatggtgcttggtttgtattatattaccaagttgcgcaagggtacacaaggcgaaggtttgactttctatggtccggaagaggctacgatcgcttacaatgagaagaagttggatatccatgctccgatccatgtttacgtggaggatttggatgcgaacggtaacttggtgaagacgatggtagagacttctgtaggtcgtttgatggtaaatgagtttgttccgaaagagattggttatgtaaacgaggtgttgggcaagaagtctcttcgtgacatcatcggtcgggtaatcaaggcttgtggtgtggctcgtaccgctcagttcttggacgatatcaagaacttgggttactatatggcattcaagggtggtttgtccttcaacttagcggacgttctgatcccgcctgaaaaggatgagttggttcagaagggatacgatgaggttgagcagatcatggctaactataatatgggtttcattaccaacaacgagcgttataaccagattatcgatacttggacacacgttaatagtaacttgtctaatatcttgattaagcaattgacggcggataacgatggattcaactcaatctatatgatgatggattccggtgcccgtggttctaaggagcagattcgtcagttgtccggtatgcgtggtttgatggcgaaaccgcagaagagtggtgcagaaggtggtcagattatcgagaacccgatcctttctaactttaaggaaggtttgtccgtgttggagtactttatctctactcacggtgctcgtaaaggtttggccgataccgctttgaagactgccgacgccggctacttgactcgtcgtttggttgacgtctctcacgacgtgatcgtaaacgaggaagactgtggtacattgcgtggcttggtttgtacggaattgaagaataacgaggaggtgatcgcttccttgtatgagagaatcttaggtcgtgtatctgttcacgatgtgatccatccgattacgggcgaggttatcgttcgttccggtgaggaaatccgtgaggatgccgctaaggcaatccaagactctccgatcgagagcgtcgagattcgttccgtattgacttgtgagtctaagaagggtgtctgcgctaagtgctatggacgtaacttggctacgaaccgcatggttcagaagggtgaggttgtcggtgtaatcgccgcgcagtctatcggtgagccgggtacacagttgacgttgcgtacattccacgtcggtggtatcgcatccaacatcgctacagagaatagtattacatctaaatatgatggtattttagagatcgacgagcttcgtgctgttgaggcggtagacgaggtgagcggaaagaaacatttggtagtagtaagccgtttggctgaaatgcgcattgttgatccgaacacgaagattgtgttgttgactcataatataccttatggttctaagttgttcttcaacaacggtgactcaattaagaagggtgacgtgatcatcgagtgggacccgttcaatgccgtaatcgtgtcagaggtttccggtaagatcgagttcgagagtttggtagagaacgtgacttacaaggttgagagtgatgagactaccggtttgaaggagaagatcatcatcgagtctaaggataagacgaaggctccggccgctcatatcgtggatgagaatggtaattacttgaagaactactctttgccgttgggcgctcacgtcgtgaaagacaatggtgatgtagtgaaagctggtgaggttttggttaagatccctcgtgccgtaggtaaggccggtgatatcaccggtggtcttcctcgtgtaaccgagttgttcgaggctcgtaacccgtctaaccctgctgtcgtatctgagatcgacggagaggtaggattcggtaagatcaaacgtggtaaccgcgagatcaccgtaacgtctaagttgggtgaggttaagaaatatatggttcctctgtctaaacaattattggttcaggagaacgactatatccgtgcgggtatgccgctatcagacggtgctaccactccttcggatatcttggcgatcaaaggtccgacggctgtacaggaatatatcgtgaatgaggttcaggatgtataccgtctacagggtgtgaagatcaacgataagcacttcgaggttatcgttcgtcagatgatgcgtaaggtagaggtggttgatccgggagatactcgcttcttggagcagcagattgttgataagttggaggtaatggacgagaacgatcgtatctggggcaagaaagttgttaccgatccgggagattctcagacattgcaggccggacagatcgtgactgcacgtaagttgagagatgagaatagtatgttgaaacgccgtgatcttaagttggtcgaggtacgtgacgctattccggctacagccaaccagatccttcaaggtatcacacgtgccgctttgcagacgaacagctttatgtccgccgcatctttccaagagacgacgaaagtattgaacgaggctgctatcaacgggaaggtagatcgtttggaaggtttgaaagagaacgttatctgtggtcacttgattcctgccggtaccggtcagcgtgagtttgataagctgatcgtaggcgcaaaggatgagttcgatcgtatcttcgctaatcgcaagaacgtggttgatttcaatgccatggacaaagatgatgaagaataggaacgtttaataaactataaagaaaggccggcagagcaatctgtcggccttttttgttcttccttatttgcttaataaatggataaactttatttttgcgaggtaacaaagaccatagataaatactgagacatataagaaacatataataatcaatatcatgaagagaattttactttgtttaatggtggctttatttgccactggttgcttattcgctaaaaacaacgatgagaaaatgaatgtaatgtcttataacatccgttacgataatttgggtgataaggataatcaatggaaattcagaagagatttcgctgctgatttagtgaaattctatgaggcggatgtgttcggtgcgcaagaggtcttgaataatcagctgaatgatttgcttaatcgtttaccggaatacgcttatgtgggtgttggtcgtgaggatggcaagacgaaaggggagtacgctccgattttctatcgtaaggatcgtttctccgttgataaaagcggtaatttctggttagccgaagatataaatgccattggtaagaaaggttgggacgccgcatgcgagcgcgtagctacttgggcgatcttgaaagataagaatacgggaaagaaattcttcttcttgaatacgcacttggatcatatggggaaagtggctcgtcatgaaggagcttctttggtgctggagcaagcgaagaaattatccgagaatttacctataatcgtgactggcgatttcaatgccgtgccttctgatgagccgatacaagtattgactaatccgagtgatcctcgtcatttgactcattcccgcacgatcgcagggtttacttacggcccgaaatggacattccatgattttggaaagatcccttacgacaagcgtgaatggatcgattatatcttcgtgaaagggaatatcaaagtattgcgtcatggtgtattgactgaaacgttgaataatctgttcccatccgaccattgtccggtaatcagtacgttgatactcgaataaaaaagctttgtgtgtatggggaaagtagacgtattgaaggaaactaccccgctttcatcagaagattgcttcttggtcatgcaacgcccgaaatcggggtttaattttccgttacatgtacacatggaatttgagttgaactatctggagaatgccgctggcgctatccggatagttggcgattcggtcgaggaaatcgatgatctggatttggtgttgatcgcgggaggaacgaagcatgcttactcgaaccataagtgtccgtgtaatgggatctttgagataacgatacaatttcataaatcgttatttgatagcttgatcaatagacggcatttcaagaccatgaaggatatgtttgataacgcttccagtggtcttgttttcagccgggaaatgatacttggcattcaagataaattaagaatgttgtcgaacgataacaagccggattctttcaagaacctgttgcgtttggtcgagattcttaagattctatctttggataaagcagcccgtcggttgaatgccgtgaacacggtaaagaactataataataacgataccgatcgtttagatagtatcatgttatatttacacgaaaataatcaaaaacgtatcaccttgtcggaagtggctaagttaacaaatatgagcgatgcctcattgatgcgtttcttgaagaagtggacgggaaagacatttatcgataacttgaacgagatccgggtagccgaggcggtatgccgtttgaccgatacaagtgacagtatttctgaaatatgttacaggtgcggttttaataatctatcgaatttcaaccgggtattcaaacggcgtagggggagtacccctacagagtacagggagaaatattcccgttcgaggtttataatttgaaacatgatttaaagcatgtttacattgatttgtgtcaagtgttgatgatatagtattatttattgcacatatagtatttggtggtctttgctaaagcccttacttttgtaaagttcaagtgaaagagattagcacttagacaaaacaaaccttaactaaaacgccaaaaccaattatatcaaacacaaaaggtatttttacattggtctaaagaattgagaattaaaaacacaactagaaaacgactgcctgagaaggtagtcgtttttgcatttatagtcttcaaccactttgtaacccggaataaatatgtatatttgtcttcgcaatttttaatcaccataaatttaaaagaagaaagtatggaaaacaacaaacctgccaataacgagattcagatcgagttatctgaagaaatggcacaagggacttacgccaatttggctattatatctcattcaagctctgaatttatcctagatttcatccgggtggttccgggagctcctaaggcacaagtcaaaagtcgcgtaatcttaactccggataacgctcaacgtttgttattcgctttgcaagacaatatcaagaaatttggggagcaacttcaagcaggaaataataataacaaaacagctaattttgaggacttcgcaggtccgacaggagaggcttaatagatttgttttcagccatagaaagagtacttttctacaagagtaggggagtactcttttattgttgggatggctcgtttacattgaaaaaccttgatgcctattcttagatgcttacaatgggcattctaaggtgttaagaatgcctgttataaacacctaagaatgcccatcgtaaagaataccctatctctctatcctaaagattagataatcccatcaatattttcttcaatacggtttgcgcagagatctcacggttcgcggcctcggggattacgatactttgcggactctctatcacgtcatcggtaacgatcatattgcggcgaaccggcaagcaatgcatgaaataagcgttattcgtaagtgccattttctctgcgtctacggtccagctacgatctgtgctgattacttgtccgtaattcggatctttataagcggaccagttctttgcgtaaatgaaatccgctccttcaaaagccttcttctgatcgtattccactttagcgttgcttacgaatctaggatcaagctcataaccttccggatgagtgataacaaactcataatctgtagcgttcatccattcggcaaagctgtttggaacggcttgcggcaatgatttcggatgaggagcccaagtcatgactaccttcggacgagctgttttcttatattcctctatcgtgatcaagtcggcgaaactttgcaacggatggcgtgtcgccgcttccatgctaaataccggccggccggaatgctcgatgaactgactcaatatcttttcgttataatcatcttctttattctcaaagcgtgcgaaagaacggaccccgatcacatcgcagtaacagcccattacaggaacagcttccagcaaatgctccggtttatcaccatccatgataacacctcgctctgtttccagcttccatgcaccttggttaacgtccaaaacgatcgtgttcatacctaagttcatggcagccttttgggtgcttaagcgggtacgtaggcttgagttgaaaaatatcatcaacaacgtcttgttttttcccagttcactaaactggaaacgatctttcttgatctcgaaagcttcattaagcgcttgtttcaagtcacctaaatcctgtacgcaagtgaaatgtctcatatctgttacaataatattttgttaaaggcaaagataatgactacttgtcaattatcctttagaaagaccaaggaattgtttaagagatcgtatccggaggtgttatgggtagtttgaaactgaaggtagaacctttcccttcctccgagttcacccagatggtacctcccatggcggtgaccagacctttacagatcgaaagccctaacccggtgcccggctggaattcgttcaattgcacgaatcgttcgaagatatgtcccagtttgtccttcgggatgccgttacctgtatcggacacgtaaaattgcacgctgaccggatacaacgattggtatccgaaatgaatttctcctttctccgtatatcggagggcgttagaaagtagttttttcaagataagcataagcttatgtttatccgtgtgaagagatacgtttggagaatcatccaagattaaccgtacgtttttggatatgcggggagaggcgtattcgtatacatcgtgcatgatagcgagcggatttacatcctcatatgaccaattgatcgtattggactcgattctggacatctcgagcgtgtcattgattaattcgagcaaagccgtgttattttctttaatcatggaaatatactgttcacgcatttccggatcatcttccagtcctaacatatcggagaagccgacgatggcatttagcggagtccggatctcgtgcgtcatatttgccagaaacgtagatttcaatagggaaagatccttggatttctgatgatccgcgatagctagctcgtcgttttccttttcgataatgctacctataatgacatgtggggtgccgctttcatcaatatccatgcttttacccgatatttcatacatcttataagtcccgtcttgattcctcaggtggaaggtgacgttgtgagacgataatttctcgtcccggattttattgaacagatagaagaaatccaaactatcctctggcttacgtacggatgataaagccctgcatataaacctgtttttatctaatagagtattggtcgtgccgtagaattgaaaacagcggttacaatgctttttgtcgcaagtggagaaacggtcgaagctgaatgagtaagcggctaatttaccgtcttccaacgcttgccgcatcaatatccggctctcgttcaattgtcccatcaatagtttattttccctgtcagtttctttttctccctgctgcgtaagccaaagcgtatacccgctaagcccctgttcatcggtatagatgggttctactttaaacgtgacgggctcttcgcatataattgcgtcaccttttcttaaagatgacttcaaggaatcggttagtacgatgttattaaatagatgttctataataaagtcatgcttatccgccaaggaaaaatgagcgaacatcgccttattcaagtctatcagatttccttccgtatcatagatagcccctcctaaaggacaggaatagaatgtatttgaaactaaagtattgaaaatatttgaatctattactgttgacattattcgtttagatttaagtgttgttctagaagaaagagacaggcgagttcctatattctcgtctgcccgtctccttctatgatgtatttataagtcgttaattcaggaagcgccatcggtccccgggcatgtagcttttgggtactgattccgatctccgccccgaatccgaattgggccccatcagtaaaggcggtagatacatttgcgtatacgcaagcggcatctaccaattgctggaagcgccggatagtttccggatcttcgctgattatgctttcgctatgttttgaactgtaccgggcgatatgtgatagagcctcgtctaaagaggatacggtacggatactcattttgtaatcgaggaactcggtaccgaaactgttttcgttagcctgttgtaaaagcgtctccggataatgttcggatagagcggcataagccggttcgtccgcataaatgattacgttgctgtccggaagctttccacagatatacggaagatcagatagacgttctcggtggatgattaagcaatccaaggcattacatacgctgaccctccgtgtctttgcgttatttacgatctcacgtcccttgcctttatctccggagcgatcaaaataggtatgacagataccggcacccgtctcgatcaccggaactttcgcgtgttcccggacgaagtgaatcaaggaactgcttccacgaggaatgattaagtcaaccaagccgaccgctcccagtaattccgccgtagcctctcgatccggaggtagtaaagtgcataccgccggatttataccctgacgctccaatacagaatggatgatgcgtaccaaggctcggttagagaagtccgcatccgatccaccctttagcacgcaaacattaccgcttcggaaacataaggaaaaaacatcgaaggtaacattcggacgagcctcatagatcacaccgatcaccccgaaaggcacggttacttttcggataaccattccgttcgggcgggtagtctcgctcaagaccttatttaatggagaaggtaatgtcgatacattctccatatcggcggcgataccttgtagcctttcctctgtcaatttcagccggtcgtatttcgggttcgcggggtccatacgttccagatcttggcgattcgcggcgagtacctcctccgtatgagtccgtagaacctgcgctgtctcctttaagatcccgataatcgtttgatccgatagcgttatcaattgtttagccgcatccgatgcctgtcgcagcatatcttttacattcatactttttaatccagatatagataatcataatgtataagcggttttaaatcccgttgccctatttgcttacgtgcttcctcgctgtcataggcggtacagcctacgccgatttgcacgccttcctcattcattatctttacgatatcatctttttcgaaatcaccctcgatgcgggttactccaaccaataatacgctagtcgctttcggggcggtcaatgcctcctcggctcctttattgatatgtatttcccctttggcgaaaccctcggagtgggcgatccatttctttacgctgctgacgggtttcgaggccggaatgaaacgggtgcagaccgtgtcgctatccaccgccaataacatcggaaggatattatcctttttgccgttggcgatgataaccgcaataccttcgtccgccactttttgggcgatatgacatttcgtcaacatacctccccgtccaaaggatgatttgctagtctgtacatattccgacaaatctgttttcccacattcgatttcccggatcacggaactatccgggtccgacggatttccattgtaaatcccgtctatattactgagaatcaccaaggcatccattcccatcatcgtagcgatcaagccggataactcatcattatccgtgaacatcagctcggttacggatatcgtatcattctcatttacgatggggatcaccttgttttcaagcattacctccatgcaatgcttctggttcaggtaatgcgtacgactcccgaaattctcttttgtagtaagcacttgcccgcaagtcatgccatgctcccggaataactcgtaataccggttgatcaacttggcctgtcctaccgccgaatacagttgccgggctgatacgggatccagctttttgccggcctttatctcgcttcgtccagaagccacggcaccggaggagatcaagacgatctccataccttgccggtgcaagtccgctacttggtcaaccaacgcggacatgcgggtgatatctagcgtcccatccttgcgggtcaggacattgcttcctatttttacagcgatccttttcaagaaagttatgatttattatttattatctttatcccggatctctacccgtcggatctttccgctgattgttttcggcagttcgtccacgaattcgacaacacggggatatttgtaaggagcggtgacacgtttcacgtgattttgcaattctttgaccaaggcatcacacgctttatccttataatccttcgccaatacgatcgtggcctttactacctgtccgcggatctcgtcggggacaccggtgatagcacattccactaccgcagggtgagtcatcaaggcactttccacctcgaacggcccgatacgatagccggaactcttgatcacgtcgtccgcgcggccaacgaaccataagtaaccatcctcgtcacgccaagccacgtctcccgtgtaatacaggccatcgtgccaagcttcccgggtacgttctgcgtcccggtaatattccttgaataacccgataggcttgccatttgttgtgtggatcacgatctgtccttgctcgccatcctccgcacggcttccgtccggacgcaataaatcgacatcgtactgcgggttgggaacacccatagagcccggtttcggctccatccacgggaaagtggcgactgtcagcgtagtctctgtctggccgaagccttccatcaatttaatgccggtcaacttatagaacgtgtcgaacacggcggggttcaaggcctcgccggcgatcgtacaatattgtaaagatgataaatcgtatttagtcatatcctcacgaattaagaaacggaagatcgtaggaggagcgcaaagcgaggtgatccggtaatcctgtatcatctgcaacatatcagcaggcgtgaatttctcgtggtcgtaaacaaatacggtcgctccggcgatccattgcccatatagcttaccccaaactgccttgccccagcccgtatccgcgatcgtcaggtgaaggctgtccttatgcaagttgtgccagaaactaccggtcacgatatgccccagcggatacgtaaagtcgtgggccaccattttcgggtttccagtcgtaccggaggtgaaatacatcaaagagatatcgtcattgctatttgggtgagacgggcggacgaaaggagcggcgttttggataccctgttggaaatcctcgaaaccttccggtatttccggccctacggatacaacactttttacggtcggtgagtccggcaaagcctctatgatatgtttcgttatcacttcctctccggcgcaaacgatcatcttgatatcggcggcattcgcacgataaacgatatctttcttggtcagtaagtgtgtagccggtatcacgacagcccctaatttatgcaatgcgatgatagagaaccagaactcataacggcgtttgagtatcagcatcaccatatcgccatgtccgatccccaaggattggaaataagaagccgtctggtccgtataccgtttcaagtcggcaaacgtaaaatcaatatgctctccatgatcgtttgtccaacataacgctttcttatcaggttcttcctccgcccaagcgtctaccacatcatatccgaagttgaagttctccggaaccttgatcttgaagtttttaataaaatcttcttgcgactcaaacgtcgttttatctataaatctttctaacatgctgttgatcgtttataaaatgacggccaagaaactgaccttttccccatccagcgctttcataccgtgaggaagctctgagttaaaataaatactatcaccttcttctaagataagatctttattgttgatctgtagtaacagacgtccttttaataccatattgtattcttgccccggatgggaattgagatacatcggctcatcctctggtttgggatgtacggttaccaagaaggggtccgctttacgtccgacgaaaccggcggccaatgattggtacttataggctttcgtacgctctacggcaacaccttttccgttacgagtaataaagtacgtactcattttaggctcgtcgccaaacatcaacgtggttaattctacgccataagcctgtgagatctggtgcaatacgctaacggaaatatcaaccgtgccgctttccagcagcaaatattgctcagtcgtgaggttgcagacctttgccatttcttccggcgtaatctccagtgcgtcccgtaatccggccagacgctctgcgatttgttgtatctgttcgttcattttgctgaagttattgtattatgtcgctccaaagataggaataaaaagcaaaaagaaggtgaaagcccttgttttcttttctaattaacaggtatggcttgtttttaatacaaatgacgcagataatacggataagaatagcaaatccgtgtcatctgcgtctgaaagataagcatctaatacttattcagcatttttctttagccattctaaccggcgctgatccgggaggtgttttaccttgaaatgctcgaatatcacattaaatcctttcccgtcgggacaagcggccataaacccgacttgtacggggatattgtcttgtagccaagcgttacgcataagggttccttatcatcgaatgagtagaagatctccacggcgtccaatctccggacagcttttatccatacataagggatcgctttgtctaaggtgataacgctccagtcggaggtcttatgcgtaacgaccgcgcttaggttgtatttaccatccacgaactctataccggcttttatataattttcatgattgatgcgaagcatcaggccggcttggtcaaaacgctgcttgtaatcgccggttatcttgactttcacttcgaattcacccccataagtcgcataataaaaaggagcgtcatctaccgtaaacccgtaatgggaaatcctccaatagtcactttggggagtgacctgcatggaaagtgacttgtctttaatctcccattgctccggctcgttgaaccattgcatcttatctaatgattgcgccccgcaaaattgcaaagaggcgacaataacaaaactcagtaatactaattttctcattttacttcttatttcttattttgattctttctattcccgtaagaagttaatgttattaaccttacctccgcaaaggtaacgtgttattatagatcgcgcaatgattctgtgattttatctaggaaggaaaagtaagggttaatgtgttttcgtctattcgtatttgataacctcgaccgggcagctttcggcagcctctttaatacccgcctcgaaatcatcgaaattaactccttcgtttacacgtgaacgatctgtaacagtgaatacttccgggcaaatgccctcgcatgtaccgcaagcgatgcaatcctcttcaatccaaactcttttaattgccataattttattcctttaagatgattaatatgttaatgtaacaaacaactttcgcggattgttttcgggagaggtcttttagatcattgtatagaccgtgaaatgagcttatctttggttgatatatattaacgtttacacgccactgttttaaaataaatttgctacgtttacagcagaaagtttcattgaataaccatttaaaaaatctgaagtattatggataatgctatttttagatttcctaaacccattaatgagccggtaaaagcgtatgctcccggatcaagtgaaaaagcatccttaaagaaagcgttggcgcagataagttccgaggaatgggatatacctctggtaattggcggaaaagagatccgtacgggtaataccggtaaggtcgttatgcctcatgatcatcatcatgtattggctacttatcataaggcgggcgagaaagaagtacaaatggctatcgacgccgccatgaaagcgcataaggaatggtcagaacttccatgggtggaacgtgcgtctattatgcttcgtgtagctgagttgttggctacgaaatatcgttatatcctgaacgcttcggttatgttgggacagagcaagaatccgttccaagcggagatcgacgctccctgcgaattgatcgatttcttgcgtttcagtaccttctacgctagtcaagtatatgccgatcaaccctattccgagacgggtatattgaatcgtatggaataccgagccttggaaggtttcgtgttctcgctcacgccgtttaattttacgtcgatcgcttccaacctgaatatggctccggctatgatgggtaacgtggcggtatggaaaccgtctactacggcgatccattcgaactatttcttgatgaaggttttccaagaggccggcttgcccgatggcgtagtgaatttcatcccgggacagggtagcgtgatcggtaaggtgattacgggtagccgtgatttggcgggattccattttacgggctctacctctacgttcaataccttgtggcgtcagatcggagagaacttggggcattataaatcttatccgaagatcgtaggcgagacaggtggcaagaactttatcttcgctcatccttccgctccggcgttggatgtggctaccgctatcgtacgcggcgcgttcgagtatcaggggcagaagtgctcggcgggttcccgggcctatatcccggcttctctctggaaagaggtgaaagattacgtgggcgatatgctgaaagagatcaagatgggtgacgtgcaggatttcacgaactttgtcaatgccgtgatcgatgaggcttcgttcgataacatcatgagttatatcgattatgcgaaacagtctccggacgcagaggttctttttggtggtaacggggacaaatctgtaggttatttcgtggagccaacggttatccagaccacggacccgatgttcaagagcatggtagaggaaatcttcgggccggtgattacgatctacgtatatgacgacgctaaatatgaggagactttggaactttgtgatcgtacttctccgtacggattgacgggttctattttcgcccgtgatcgctatgcgatcgataaggcattcaataccttgcgctattcggccggtaatttctatatcaatgataaaccgaccggcgccgtgatcgcccagcaaccgttcggcggttcccgtgcgtccggaacgaatgacaaggccggtggcccgctgaacttgattcgttggacgaatcctcgttgtatcaaggaatgtttggttcctccgacgagctacgggtatccgttcttaggtgagaaataattgtcataattaagaaataccaactgattgtgggggagacggggcgtgccccgtctctacgctatgacgttacctttatctacatacaatatgttagactttaacaataccgagatcgctttctcgtcgaagtcgcggggagaactacaaaatgcttactggctttttaatacgataaaatatccttggttggtaaaatgcgctaaagtagccacgagtatagccttgaaaatacatttcccgctggcttgggcggtgaagcctaccttatataaacagttcgttgggggagaaactttacaagactgttccgcagccatcaaccacttgatgaaatacaacgtgaaatcgacgctcgattattcggcggagagcgagcagaccccggagggcatacaggcgactttcgaggaaaccttgcgctcgatagattttgcgaaaggaaatacgaatctggcctatgccgtattcaaaccatccacgatcacgaccgatgagttactggccaaagcttccgagaaacgggaagagcttacgatagacgatgtccggcatttccgcgagttccgcgagcgttttatggcgctttgccaacgggcttacgataacgacgtacgtattttagtggatgcggaggattattgtttccaagatgccattgatgcgttgaccgatgaggcgatgcgtaagttcaacaagaaacgtgcgatcgtattcgctaccttgcaaatgtatcgtcatgaccggatgccttatctgcgtcgtatctacgatgatgccgtggcgaaaggttatattgcgggcgtgaaattcgtgcgcggggcttatatggaagcggagcgtgcccgtgcggcggcgttggattatcccgatccgatttgtaaagataagcaggccacggacgagaattatgatgcggcggtccgtttcaccatggatcatttagatcgttttgagatgtttatgggaactcataatgaggagagtaattataagttggcgaaattgatggacgagaaggggatcgcccgcgatgactcccgtgttttctttgcgcagctattgggaatgagcgataatatttccttcaatttagcccatgcgggatataacgtaaccaaatacgtaccgtacgcctcggtaagggatgtactgccgtatttgatccggcgtgcggaagagaatacttctgtcgcggggcagaccagccgggaactccggatgttggagatggaaatgactaggcggaaagaacataaacctgccgagggcaggtaaagtagtttgtcagcatatttcggggcgtattggtgctggcaaactactttgtctgcctatttttatttactggccttcagtccccggatcacggaagaggtaaaaccggaaagttccatctcatttagacccttgatcgtgattccgcccggagttgttaccttatcgatttccatctccgggttacttttgttctcgagcaataaatcaacggcgcctttcacggtatgcaccacgatctcttgcgcttgtttcggatagaaacccaattccacgccgccttctatcgccgcgcggatataacgcaaggcgaaagcgatgccgctggaagccaatgctgttcctgcgcccatcaaccgttcttctaccaacatggcgttgccaagctcgttgaagatatggatgattagatccgtttgctccttggaggcgttgcgggcggaaacgaaagtcatgctgctcatcacctcgatagccgtgttgggcatgatccggaagatcgtgggagtagccagacaatcgaagtctgtattcttggtcaaataagtattcaacaggtcgaaagtcacgccagccgctacggatacgatgatttgtttctcgaagtcgagcaccgacttaatctcatctataatcatttctacacgccaaggtttaacggcgatgatgatgatatcagcgtttcgtgccgcttccacgttatcatgggtcaagataaagtccggatcgatctttctcatcttctccaaggtctcgtccgattgggcggtacaagtgatatcagaggctttgaacatggttcctttcgctaaacctcgggcgatcgctccaccgatattacccgaaccgataatagatattctcattttgcagataattagttatatattatgttttctgaagaggcaaacttagataaaatatctcaaatacgtacgactttgtagagttagctacggataaaaaacttacatttgcggtcgatacggacttaatactaatataaatatataaaattacatgaaaaagacaattctagtttcaagcatgctattcgctctgactatgtccgctacgatccaagcgcaagacacggagaagaaggtgagtgaggagggattcgtgttcacgaccgtgaaagagaaccccattacatctgttaagaaccaaaatcgtgcgggtacgtgctggtgctactcctcgtactctttcttggagtcggagttgcttcgtatgggaaagggcgagtatgacttatccgagatgtttacggtatataacacctatctggatcgtgccgacgctgctgtgcgtacgcatggggatgtttcgttctcgcaaggtggatctttctatgatgcgctttatggaatggaaacattcggcttggttccggaagaggagatgcgcccgggcatgatgtatgccgatacgttgagtaaccataccgagctttccgccttgacggacgctatggtggccgctatcgccaagggaaagttacgcaaattgcagtctgatgagaataacgccatgttatggaagaaggcggtcgctgcggtacatcagatctacttgggggttcctcctgagaaattcacgtataaagggaaggaatatacaccgaaatctttcttcgagtctacaggtttgaaggcttcggattatgtctcattgacttcttatacgcatcatccgttctatacccagttcccgctagagattcaggataactggcgtcacggtatgtcgtataacttgccgctggatgagtttatggaggtctttgataatgcgattaatacgggttatacgatcgcttggggttccgatgtgagcgaatctggttttactcgtgacggagtggccgttatgcctgatgatgagaaggtacaggagttgagcggttccgatatggctcattggttgaaattgaaaccggaggaaaagaagctgaacacaaaaccgcaacctcagaaatggtgtacccaagcagagcgtcagttggcttacgataattacgagacgacagacgaccatggtatgcagatctacggtatcgccaaggatcaagaggggaacgagtattatatggtaaagaactcttggggaaccaacagcaagtataacggtatttggtatgcttccaaggcgtttgtccgttataagaccatgaatatcgtggttcataaagatgccttgcctaaagcgatcaaagccaagttaggtatcaaataaccgatctgccaaggagggttcaaataaaaactaaaccccgatagcttccggcgatccggtaagtctatcggggtgatctatatatacaaagatgtgctgcctataaatttattggacaagtcttagcgtgtagttaagatctgccgccgctttttgcaacgcgtcgttcatcaaggtcaagttatccccttctactaggaaatagatgacgggttcgccatcactgggaatcaactcgtagattactgcgctagcgtcatcgggagttccgtgctttactttttgtttaccggttgtaatggctttctgaggagctttcttcgccgctccggtacttgaggctactgcttccggtacggtataaagagcatccaactcgaatacgccttcctcgtctgcgttatcttgttgataatacaaggttaagtcataatctacgttcacgctatccggagaagtcagggttcccttatactttttttggataaccggtccctttttaggatcagccttcaaggaatccctcatattcacgggctttgccggttgggtcgccttaacagaatggatcagtggcaaagacggagcgtccggagccgccgacattatggcgaattcttcttcctctacttctacgggtacatccttttgggcttgcttcccgctacatgcggccaaaaatgccatagccgctactgcgataaaatactttttcattaccattatttattttattagtgacgtttggatatataacataaaatcccccacgatttgtttcgtgagggatcatttttaactatttaccgtgaaatatttatttcttggaaggctctaccctgtcatccggatagggagcggtcgggatcgtggaagcgcttccgtctcgtccggcgaaatagtgcggtgacatgatctctacgccagcctcattgaatacgtcctgtatgttttgatgcaggtcggaatagatatctccgagtttatcggcgtcctttatataagcgttgatttgataacagggatagtaatcgcttagttcggtctccaatacgaaaggcttcggctctggcaataccccggtggtctggcgggcggcattgatcaataattgatgaacttgccgccaaggtacgtcgtagccgatcgtaaccgtgctgtggatgattaatccgtattgccgtgcggatacgctataatttgttgtatgggaggacatgataaaggagttcgggatggtcactacctcattcttaggggtacgtaaacgggttacaaacggagtcttctcgatcacgttgccagtcgtctcgtttagttggatacggtcacccaatttaaagggcctcatataagtaatgaccagccctgcgatgatatttccgatcaccgtactggaacccaacgatatgatcaaaccgacaaatacggatatgccttgaaatacccccgagtccgatcccggcagataaggatagatcatggcgatcataaaggcgtatagcaggaaacggatgatattaaacgtcggttgcgcccaatccgggtaaaaacctgatattttcaggttctcgctctctatctcgttggctatgtattggattccttttacgatgtatttgatgcagtaatagatcaccaagatgataaacaagttcggaatataggaggctaccgatttaaagatcatctttaccggctccaacaaataggagaatatcttcaaggctagatcttctgtttgcgggaagatagcgaaaaggatcggtacactgatggttaattggattagtaacacgatccatcgtattacgttggtgaaaaacatcaatacacgtccttggcgatgtgtgttgagaaattcataatcccggatggtaatagatctgagtcggttctgctttaaccagataattttcctgcgtagcttcttaaacagatagttggtcagcttaaacaggaaatattggatgataattacgaggatgaacaataatacccgtttcgctatctgcaagatactatgttgctcccttaactcttgtatcttgttttggataatcggttgatattgttcagcgagggctatacgactgagattttgccatagggcatcttgatcggtgatacttaggataaccttgtctccgtacatgatatccgttacgtattcgctgtcatagatatagatggaatccttcttcaaggaatgcgaggtcccgatctttaccatgatattgaggatgtcctcagcccggtcaaccggggtgcggcctccgcgcttggcgtaaaggtgaaataaggtatccccctccacgactacaggtacgccgggagtcagtgcccgaagggaatcgatacggtttcgttgctcggacctttttagggagtcggcggtagcgttgctgtttttcgtgctttccagctcgtctttcagtaagatctcgtttagtttcatctcttgcaactggagggctagctcctgcatcttgatggaatccttccggtgctgctcatcgagcgaaagcgtatcggttggggtaactggttcctccggatcattgcctaatgtcgtagacaatagttcttcggccttttcccttaattgggcgttggacaccgttggcaggaaactgattcctgccaagatcactaatcgcaataaaaattgtttcatcgaatcgtggattaactatttaccaccggccggaagatgttccagccagtatttagccattgtcttacgtaggtgaagagttgttccttccctttcgttgatgctatggctacgcatcgggtaactgatttgcgtaaacatctttccgttcttgatcaacttgttcaccagcatctcgcaattttggtaatgcacgttatcatctcccgtaccatgaataagcagcagattaccttccagtccctcggcataggtaatcggggaacctttgtggtagccttccggattgttctgcggagtattcatgtaacgttcttggtagatcgtgtcgtataaacgttggtcggctacaaaagcgatcgctataccagtatggaatattttcggataacggaacatgcagtttaaggtctggctaccaccaccgctccatccggtaataccgatcctgttggcatcgataaacggatattgacgggtcatatccagaatacccctgctctggtcttcggaagcgaaagtacccacttccccgtaaatacatttccgccattcacgtccacggggagtattcgcaccccggttctcgatacttaccacgatataaccttggttcgccatatattgttgccataaatctccgttaccccatacatcttgtacggtggcgctcgccggctcgccgtatacctctatgataaccgggtatttcttggatgcgtcgaaatcgacaggttttatcatccatgcgtccaaggttagattgccggacttgaccttgataaattctttcgggtttaatcctaaggcggcgtattggtccttggcttgggcattatcctcaagcatgcgtacggattgatgtttcgggaaagaaaccatgtcgataacggatggggtagaggcgttactatacgtatgtatggcccatttgccggtgggtgacatattgtagcggtgctgtccggattgttccatggggcttacacgctccacttccccattgccgaatgctttagcccggtacaagtaacgttgggtgaaattgtccggggaggcgatgaaatagacccagcccttttgtagatcggtcccgaccggcgagatataatcaaaatcacctttggtgatgggttgtatctcttttccgtcccggcttatccggtataagtgtcgccagccactacgctcgctttcccatgtgaaatagcggttgtcctttaaccattgtatgttatcattcgtgtccagccatgcggcatccgtatcagtgaagatattattcagcgagttatcggatatcttggcgatccataccttatttgtattctgcgggcggtttagttgctgtatgaacaactcgtcgctttcggggatgaattccatacggggcaggtagttgttccggggatctccgggtatggcgatccaagtggtgttcccgccggtagaggaaacgtagcctacttttacggctgaattggtggttcctgccttggggtatgggaaatggattacctttgcgtagatggagtctacattattaataatgtcgaacactcccgttcctttcgtatcgctttgccaataggcgatatgctttccgtccgggctccagcggaaaccatcccggcaactgaactcctcctcatatacccaatcgaaagttccgttgacaatcgtatcgcttccgtcttttgttagctgcgtgattttcccggagtctatatcttctacatatatattattgttggaaacataggccacacgtgtgccatccggagagaatttagcgaacatcatggaggattccggcattccttttcccaattgacgtaaagcgccgtcctttaggtttaatacccaatagtcaccccgggtatcataacgccatacccgttgggtattgttataaatcaagactttctcattatccgcactccaagagatactacgtacgggaataggctttcctgtagatttgtctgtcaatagggatgaggggataatgacttcacgggagttatcttttgcttgataggcgacgatatccgtgcctccggtttgcttattattttccaagcggctataacgttcaccgtcttttagccaagtcatgcttccgacgccttttgtttgtatgacgttaccggcaacgatatcctcaagattcaacgctttttgtgccatgcttatacctcccgacagaaggctgatcgtggcgatcgctattaatttatttagtttcatgttgtattagttggttactactatatttatgcaaagaacggaaagttagttgatataacaaaatggatttgtatattcgcgcctcggaaatcaagaataatcataatttaattttatatagaaatcggaatgaaagcactttcaatgtatgtatggtcacttttagtgatcatgatgatgggatttacttcttgtggggatgatgatgagcttcaattctcggaagaacaattggcttatatcaacaaaaacaaggaatacatctgggaaaagaaaacagagaaagatgagaagggtgaattaagatataagcaagttgttctagggggtgataccgccttataccggatcattcggaaagaaaatgagtggacaacaacacccacgatgacttccgtggtctatttgctaggtctggaagggaagtttatagatggacaggtctttcaaaagaaactggatagatcaagtttttctatgaacggcattatcccgggcttaagcggtgtcttattgaatatccatctggatgagaccgtggaggcgattatcccggcttcgctaggttatggatatggagattatagcggtatccccggaggttctactttaatctttacttttaccttggataaggtcgaatgaatattatcagactaaaggcacatttggtttgatctgacttttatctttataagatttggcacggttacttaattccgccaacgggttaatagtataagtaggtgtggtgtaattgctttattttgaatatgtatacgatttgttcgtaaatattcgatagtttcgttgcttatctccttttttctttttaatttggcggattataaacataatcttgatattatgaagactgccattgttcctttcttgttgcttctgaatgttcttgtcgctgtaaatgcacagactaaggattctgttatcttggtgaaagatagtattacggtaaaattgccggatgtctacgttacttccgagcgtcctttggttacggttacggacgatgccttatctttcgacgtgcctaacttgatcatggccaaaccggtgaatactgcatttgatattttaggagagattcccggattggtgaaagaaggggacaacgttagtatcatcggcgtccctactacgaacattattattaacggacgtagaagctcaatgtcattgtcccagattgtagagcttctgaaatctacctcggccagcaaagtaaagagtatagagcttttgtatagctctcctccaaaatatggcgtaaaaggaggtagtataaatatcattatggagaagaaagtgaatgaggatttaagtgccgatatctctttgaccggaaagcaagctttctacttctcgccaaccggattagtgaatttatcctactccaaaaagaaatatagtctggatctatcttattccgctaattataaccattcccgttcaaccgaggatatgaacgcctatcctatcgtgaaggatcgtccttatgagatcctgcaagaaaatacggcggtaggtcgttctatgaaccatacgattggggcgagtgccaattggtttatggataaggggcgtgaggtggatatttcttattatgccaagataacggattctaattccaaacgatattcgaacactctatttgtgggtattgagaatgcggaaagtaataataagttatcgggcccgaagaatcttcaaaatgtacgattgaattatgcacattccaagaacttgagcgcaggggtggattatacctattataaggatcgcagggatcaatatatgatctcggattatcccgatacgaaacaagaggtggaggctacctcccggcaaaatatccatttggcgaatgtattcgtcaactacgaacgggtatttggaaaaggatggaaaattaacgcgggcacgaatgtgcagttatcctttacggataatagctcctttacctaccaagataaacaggaggatctgtcagctacgtttgcccaaaaagaaaaagagtatacggcgggattgtatgccggtttctctaagcgttttggcaagaaactggtgttgagcgcttctctttcggcggagtataataaggcggtgattgattcggcgggccggaagtggaccttatggtctggggtaaatctctatccacaattgaacttgagttatacgatcgatccatcgaatatgcttcaagtcaatttttccagcgataagaagtatccggcgtattgggccatgagctcgaatgtttcttatttgaatgtgtatagtcaggtacggggaaatccttatttggaaccggaacgtatttatatggctagggctaattatatcttgaaaaagaaatatgtttttggactatttgccaatcatcatgtgaattatattcgccaattgtattatcaagatacgaaagcgttgagagcctattaccaatcggttaatttcgataagcataatactttcggggcgatggcggttatcccgtttcggatcggtggggtggttagctcacggttcgtggcatcgggcttcttaattcaagatgagggagtgtttatcgatatttcgtttgatcggaaaaagttattcgggcagttgatgttgttcaatacgtttactttatcaaagaagaagaacttatcgctggaagtgaatgctcgctatagtgcgccttcgatacaaggtatctatgatgtggatggtatttataatgtatcggcagggcttgtctggaacccgataccgaaaaaattaagcgtaatgctacgaggtgaggacttattaaagggcttacgtgcgaaaacgcatattgattatcccagccagaagagtgatatgacgatctattcggatactcgttctgtatcgctcaccttaaagtatacattgggcaagatgaaccggaagaataagaaagagatcgattcttcacggtttggtcaataaagttcttatggaatccattcgataacgcctgtgactggatgttgttttttccagtcctctaattccgcatacgtacgcacgccgtcttgaatgactgcttggtaatattccacgcccatgattttcgctgtatccggtgtctcatatttcagttttaagatggcctgccgggtctcgtcagtcagtacggcggttatacgttcggccattttctcgaaataaccgtcataacgggaaccttttacgatatggatcatatcaatttgccagagttcgttatccgggtcttggaaccatgcgtgccactctacgcattgttcttccgtatcgagcgaatttccgtattcgatccgtttaatgagcgggttctccgctagtcgggccatcgctaggaagctgtcggatatacggaaaggagaagtgtaaatatgaaagtcgatatccttatgtttcatgagtagtcccatattcaaggagcctactaggtttatttccgccccgacggatttccatatatttataatgtcggtttgccggatcacttcccaagctctatcttggtttcttttcgctaattctaatagatgtttcatgatttaaataatttgaggtgtgaagttaagacacgaagcgggataaggaaatagctatttatagctaggttggttttaatatatcatacgggtacactatttccggttgtagggacggggcacgccccgtccctataagttggacaatatatatttatcttttgaataaccggaataactcaccgatccataaaaccagagaggaagatccgataatgatcgcccaatcttccaagggcaaaggtattacgctgaacatctcgcctccaaaagtgacgattaagtattgaccaatcaaaatcagtaaagcgaccagcaagaagcttttactatcctttaaattggcaaaagcggaacgtccttccataaatgcctttgcgttaaacatattccagaactgtagcatcacgaagaagctgaagaaccacgataaatcgtgcggcgttaaaccgtcttgcgcatggaaatagaacaacaagcccatcaagattacgacaaaagcgaatccgacgccgaaaatattataggccatcgggcgggtgataatgaaatctccatccttaccgctccggcgaggtttatctttcatcactcgctcattcggtgggagagaggccaacgccccggcagcgaatgtatccatgatcaagtttacccataacatctgcgtgatagtcaaaggagattccgtacctaataaagaacccaatagcacgatcaaacaagcggctacattgatggtcaattggaataacaagaatttctggatattccggtacaaggaacgtccccacatcaccgcacgggtaatgctactgaacgagttgtcgataatcgtaatgtcgctggcttccttggcaactgaagtaccgtcacccatggagaggcctacttgtgccgctttcaaggcgggggcatcgtttgtcccgtcgccggtaaccgctaccacggcgcctttctgctgtaataattgtaccaaacgctgtttgtccgtaggacgggcacggcacatgatcttcaagtctaagacacgatccaaggcctcttggtcgctaagcgcctcgaatgcgggacccgtgataatgttccggtcggtatcattcgctttccacgtaccgatctgtcgtccgatttctttagccgtacccggtgtatctccggtgacgatcttcacgtcgatacctgcgtccaagcaactttgaacagcggggggcacatccgcacgtaccggatcggagatagcgacgatacctaggtacgttaaatccgtatcatgtaaacgaccctcaacgaagaaggtctcatccattccatcctcaattatctggtaagcgaagccaagcgtacgcatcgcttggttctggtaatccaataattgtttttcgatgccggctttacattccgccaccggtttgtaagttccgtctatcgccacccggttactgttggccagtacgatttcgggagcacctttcacgtaaagtaccttcttgccgagtaacggtgattgtacgattgtagccatatatttccgttccgtagagaaggtcaattgatctaggatcgtagcgttctctcttaattccagataattttggtgttgtccgttcaaccagagtaaaagggcggcctccgtcgggtttccaagggtttttaccttttcttccgagaaatcgaggaatgccgtggagttcgtggagataccttctttgatcaggttacttaactcatcctccccaagcttttggtctttcaggttgtagaaattcgtttggtagacttgcatttggttctgcgtcaacgttccggtcttgtccgtacaaattacggtagtcgctcccatggtctcacaggcgtgcattttgcggacaagattattcgtcttcaacatacggttcatgctgagggccaaacttaacgtgacactcatcggtaatccttccggaacggataccacgatcaacgtaaccgctaccataaagtagttgaggatatgggcgatgatgtccatcgccggcatcccggggaaactatccgataaaaggaattttacggtcaaggcgatgaacgtcaccccggcgatcgtatatccggctttactgatcacgctagccaagcctttcaactgtatttgtaaaggagtctctacatcgctctcgatttgcgagccttcgtagaccttaccgtatccggtagcgtcacccaccttttctacttgcattacgccatgtccgtccacgaccgtcgttcctcgcatgactacattggacggataagtcgcttccgtatcgaaatccgcctcgtttgtagtcttgctgataatcggttcaccggttagtgtggattcgttgatctgtagggagatggcttcaagcaaatgtccatctgcgggaatttcctcacctgtctccaaaacaacgatatcgcctacgacgacctcttttttcggtatttggcagatattcccgtcacggattaccttcactaaaatatcatcattgactgtattcaagatatcgaatgccttgttcgctttcacctcgaagaaaaagcccacgcaactggcaagcatgattgcgaagaaaatgccgatcggctccaagaaggccgtaaaacctttcgcctcaggtccccagcaatgtacgccagcgattatcatggacaagagccatgccactaataatatacgaataataggatcttcgaatttctccaagaattggctccataacgaagctttcttgggcggggtaagtacattctcgccgtgaaggcgcctgctctcttctacttcttgtttggttaatcctcggtactgatgttttttctccataaatttattaatctgattaagaaaataggatagcaaattacgtaaagttatacgacatatacaagggtttaacctttttgcatatatttgtgttgtataacaaattaatttttaattaaaagatgaagaaagtactattcatgttattggttatgttcgctttgagcgcctgccaatcaaaggattcatatgtgaaggagtttagtgattttgtagataaggtggaaatggaggccgctgattataccgataaggactggaagaaggcggatctgaaattctcggatctatccacggatctttacgccaagttcgaggaagagttaaacgctgatgagaaagcggagatcattaaattgcaagcgacatacgctggattgaaaatgaaagcgggcgtgaaagacgctgccaaaaaagtggataagttcttggatggtttgaaggaaggaacaaaataacctctaatacgaaaataagatgaacagaaattgggtgtattcgctatttgctttatggatcgtctgttcgttcgcctgtacgcagcctaaacctgtggcgaatgtggatgttcaaaaagagaatttcgtattctctataaaagggacagatacattgtccttggacaagtatgagttgccttctatatcgcccgcctcaaaaaagcctgtgatgatttttgcttttggcggtgggtttaaagggggagataaggcggataaaggatatattccctatttcgagttcctcgcccgaaacggatttgtggtcgtttctacggattatcgtaccaccttgaagaatctggatccttctaaagtctcttctccgatggactttatcgcagccttgcagcatgcgatcgatacggcggtagaggatttttatgatgctaccggtttcgtgattaaccaaagctcggattggaacatcgatgtggagcagatcgtagcgagcggttcaagtgccggggcgattacggtattgcaggcagagtatgatttatgtaacggacatgagttggcgaaaaggctaccgacaggtttcaactatgccggtgtgatctcatatgccggtgcggtctctggtgtgcttcctccacattgggaaaagatgccttgtccgattatgctattccatggcgatgcggataaaaccgttccttttgaacaagccgctatggagaacctcggcggtttatggggatcatccgctgtagcgaaaagtctggaaaatcttcaagcttcctattatttttataaggtagagaatgcggggcatgagatctctgggcttcctatgtcccggaaccaatacgatatcatgagcttcttgagccgtcaagtcttaggcgatgagaatttagcgatcacgacagacgaacgtgttcccggtgatacgatcgtacggaaagattttaccgtacaggattatatcttggataatttgcgttaatataataatgaaatataaacagccttaatttgacctttttagattaaactattcacccgaaggattgtctttactatatagagtgattaatagtgtgtttagtttattaaggttatgagattaacaaggttagttggatttttagggattgtccttttttgtgcagggcaatccctttttgctcaaagtaagcaagagcggaaggagcaaaaagagaaagtagtgagggagatcgtggatagcggttgtattaagatcgatgtggatcgtgccgtaccgatggccgggagatccgtcaatcttacttccccctactcattggaaatacatggtgactcgatcctgtcttatcttccttactttggacgtgcttactctgctccttatggtggtggagagggcttgacgtttaaagaagtggcgacagagaaggagcaaacctctgaaaagaaaggtagttccgaaatcaagttccgtgtaaagaccaaagaggatgtatacatgtttcgggtggaagtctatccgaatggctcggtgacaatcaatgtgacacccgtgaataaacaggctattaccttttatggtgatgtcgccttagacttgaaatagtcgtccttgccgtgtatctctttcctcgatccgcttatttaccttagcggtaaattcgaaattctttaaaccccaatccggtgcgatcagtagctctttgggggattgtgatacgaacctctctactacgatagaggggttcagtcgttcaatgaagtcaatcactaattcgatatattcatcagccgtatataaatggaaatcagaaggatcttccttgaactctttcgccatgcgggtattcttgattagctgcaattggtgcagtttaagtgtcgtgatcgggaggcgtgataagacatccgcatggtgtaatatttcatccctactttctcccggtagtccgagtatcaggtgtgccccggtgtaaataccttttgccgccgtacgacggatagcggattccgattcttcatgggtatgccctctgtttatgcggactaaggtcttatcaagcgtactttccaatccatattcaatcatgacgaattttcgctgggaaagctccgcaaaataatccaataaaccttccggcatacagtccggacgagtgccgacaatcaatccttccactccaggataggcaagcgcttcctcatatttgcgaataagagagtctaatcggtcgtatgtatttgtgtaggcttggaagtaggccagataccgcatatccggatatttgcgggaaaaaaaacgtacgccttcctctaattgctcggtaacgcttttctccgtatgacagtattctggactgaatgtttggttattacaataggtgcaaccgccccatcctttagacccgtctcggttcgggcaggtgaagcctgcgtttatggaaatcttctgaaccttgaatttgaatagatcccgtagaaaatccccaaattcataatatcgtttagtttttttcataagacaaagatacgatttctcgcaatttgaatcacttttttatgctaacttcgcgtttcaatctgaaataaagagtataaatgaaacgattaggttttagtttattgctttcgttggccgtattcggaagtgtggccgcacaaaccggaagcaagcatgttgacttaaaagaaataaccgatgggaaatttcgtcaagtgacggctatcggagagatgcgatccttgccggatggagaacactacacagccatgaacgccgataagagtatgatcattaaatattcctatcgtacgggaaatcctgtggatacattgtttaatgcccgtaaagctcgtgaatgtacctttacggattttgatggatatacaatcagcagtaccgggcatcatatcttggtttggagggatacggagtctatttatcgtcgctctactaaggcggtggtttatgattatgacgtgcgtcgtaattatgtgaagcctatttccgatgccaagggtaagcaaatgatcccgactttctcgccggatggtcgtatgtgcgcttatgtacgggataataatatttggatacgtaagtttgatttcgacacggaggtacaagtcaccaaggacggtgagttgaataagatattgaatggcatcacggattgggtgtatgaggaagaatttgcggtgacaaatctaatggcgtggtctcccgatagcgagtatctggcctttgtccgttttgacgagtccgaggtgcccgaatattctatgcagatgtatggtgagggactttatccggggtattacgaatataaatatccgaaggccgggcagaagaattcaaaggtttccgtacattcttatagcgtagtcaccaaagacacgaaggagatgaaggtcccggtagaaggcgacttctatattccccgcattactttcacgcagaatccggatcagttggctatcatgacattgaaccgccagcagaatgtattcaatatgtattatgcaaatccgaagagcggtgtgttccgtttgatcttgcgtgaggaaaataaatgctacgtggattctgattggttgacttccatccagttcttgaacaatgggtttacctatgtgagtgaacaagatggctattctcatatttatttgtattccccgacaggtgttatgcaacgtcaggtaactcaagggaactgggatgtcacgaagttcttgggcgtggatgagaatacgaagactttctattacgagtctgccgaagaaagcccgatccgccgttctatctataagatcgacgctaaaggcgtgaagacaaaactctctacggaagagggtatgaataaggcggtctttagtgacaatttcgcttatttcgtgaatacctattccaatgcgaataccccggcgaagattacggtgaatgagacgaagaccaaaaaggaactacgtgttctgcaagataacgccgcgttgaagagtaagctgaaggaatatgtttttgctaagaaggaatttatgaaggtacatacggcttcggattatgagttcaacgcttggatcgtaaaacccgctgattttgacccgtcgaagaaatatccggtgatgatgacgcaatatagtggtcctaactcccagcaagtattggatcaatacggtttcgattgggagcaatatctggcctcaaatggtattatcgtggtatgtgtggatggtcgtggaaccggtgcccgtggtgaggcattccgtaaatgtacttatttgagaatgggcgagctggaatccagagaccaagtggaggctgcgcaagcgttaggcaagttaccttatatcgataaggatcgtatcgcgatctggggttggagtttcggaggttataacacgttgatggccttgagtaccggaaacggaacgtttaaggtgggtatcgccgtggctcctccgacggactggaaatattatgactccgtttatacggagcgtttcatgcgtaccccgcaagagaatttcgagggctatgcggctacctctccgttacgccgggtgaaagacttgcaaggcaagttattgctggttcatggaaccgccgatgataatgttcattttatgcaaacaatggaatatgccgaggctttggttcaagcgggtaagcagttcgatatgcatgtttataaagatcggaatcatagcatatacggtggtaatacccgttaccatttgtatacgaagatggctaattatttattcaataatttgtaagacatggcgcagcatttaagaaagccggattggttgaagatccggcttggcggaaatgagcaattcacgaagacaaaaagtattgttgaatctcattgccttcacacaatatgcacaagtggtaaatgcccgaatatgggtgaatgttggagccggggaacagctacattcatgatcggtggtgagatctgtactcgctcttgtcgtttttgtaatacgctaacgggtaaacctcttccgttggacccgaaagagcctgcgaatgtagcggagagcatccgtttaatgaatctcaagcatgcggtgatcacgtccgttgatcgtgatgacttaccagacttaggcgcttctcattgggtaaatacgatccgtacgatcaaagaggtgaatcctcaaacgaccgtggaagtcttaatcccggattttcaaggacgattggatctggttgatcaggtcgtggatgcggcgcctgagattatctcccataatatggagactgtacgccgtatcagtccgcaagtgcgtagcgccgctaagtatgacgtgagcttatccgttttgcgacgaatcgctgagcggggtgtggtagccaagactggtatcatggtcggactgggtgagaccgaggatgaggtgcttgaattaatggatgatgttttgctggcgggtgtttctgttttaacaatcgggcagtatttacagccttctcgcaagaatattcccgtctctgaatatgtgactcctgaatgttttgaatattatagacagcaagccgttggcaaaagttttaagaaagtagagagcgctccgctggtacgctcgtcgtaccatgcggaaaagcatatatgattcatgaacttttgacaatctttgttgttattaatataaaagtggactaaagggggggaaggaatgaacagagtaaagaaaggtctagataatcaggcgataggtttattgccattgttgttattcatgtttttggataactatttttcttatttattatcttttataattggggttactttctgttttgtttgtatttttttgtttcaggtgttgagcaaggataaggtataccaatttatgcttctaccatcggcgggcacattggtcttatattccgtatttctttgtctcaagcttgaaccagtgttgtttatatactctcctcttatcacggaagtattactggtcgtggcgttagcgatcgtggggttcacgaggagaacggtcatacaacgtatacgcgattcgaaacgtccctcttttaaacgtactttgcttcgtactaccttgaacgaattttatttcctcgctcagttggtacagaacctgtacacgttgcatcttttcatcatcttgttatatagtatcttgccggaaacgatgcagaatatgcgtaccgaacgtttcttataccgggagttgggattggtaatcggtgttttggtcattgtttatgagcaaatacgtttgtccttgatgcaaggtagcttgaaaaaggaaatgtggcttcccgtattgaatgacaatgggaaggtgatcggttgtatcgcacgttcggtcagccgctctttaccgaagaaatactatcatccgatcgtgcgtatcgcagttgtttataatggtatgttatatctggtgagacgaagtaaggatgagtttgtctctccggatacgatggattatccgttccataattacgtgctcttccgacatagtatagatagcacggtcaaagagactctcggaagtttggcgcaagataaatcaattgctccacgcttcctgatccgttatacatttgagaacgagaaggtgaaacatttggtatctctctatgttatttgtttacgtacggaagagcaattaaatcaatgtaagcgccgtagcggaaagctttggacagcgaaacaaatcgaggagaacttgagctccggggtgtttagcgaatattttgagaaagagttcgcttatttgcaaaatacgattctttttgccgagagtttctgttgcggtaactaatcatcttataatgcccgattccctagctctattacttccaaatctttgatatcctttcccgcaataacgaaacgtaataaggtacgtacttgatgaaagccactttttccagccgctcccggattcatatgcagacacttcaagcttcgatcgaatactactttcaggatatgcgaatgtccggaaatgaatagatttggccgtgtatcgtataattctttgcggatctcgggattgtagcggcccggataacctccgatatgagtcatcataacgttcacgtcttctaccttgaaatgagctactttaggatattgcaggcgaatggcttgtccgtctatatttccgtatacggccctgaaaggtttcaatgcctcgaatttcgcggccaaaagatcggagcctatatcgcccgcatgccagatttcatcgcaatctttaaaatattcggcgtacttatcatcccagtacgcatgggtgtctgaaagcaatccaactttaatcataacaatttcttttattgctcgaaagtatctatatttacacgcctaagataagaatattatggagaattcatatcaatattttaaacgggacttaagctggttgtcgtttaactaccgtgtcttgctggaagcggaagatgatacgctgcctatttatgagcgtattaagttcctttctatctattcctcgaatctggaagaattttatgagatccgggttgcggaacaccggggggtaatcatgaaaaagaattattcggaggagagcgcagctgaggcggaagagaccttggcggctatcacccgggaggttaaccgccagcaacgggactattaccgtattttctcggagaagatattgccggaattgaatcgccagaatgtttacttataccagaatgagaagccggaacctttccatgaagagtttgtccataatttctttaatgaggaggttttcccattcctgtcgccggtcatgattcaagccggtgatatacgtacgtttatccgggatcgtcggctttactttgtgatccgtatgattaagcggagcaagcggatgaatgagccgggcttcgtacccgagtatcattatgcgttgatgaagattccttatgcgaaagttccccgttttatagagttgcctcagcatgacgggaaatattatatcatgtttatcgacgacattatccgtgcgaatttacagaatgtttttcccggttatattattgatggctgttacagcatcaagatttcccgggatgcggatatttatttggatgatgagagccgggcgaatatcgtggagaatatccgtaagaaggtaaagaaacgcaagatcggagccttgagccgttttatgtatgatcaagcgatgccggatgattttctggcttttgtttgcgatgcctttggtattacgtcggaggacttggtgttaggtggacgatataataatttgcaggacttgatgaaattgccgaatccggcgggaaagcatttagagcagcagccaccggtgcctatgcgtgtgcctttccttgatgagatggggtcggtattcaaggccgtgaagaagcgggatatcttattgcatttcccttatgagtcgtttgattatttgatccgctttttgatggaggcggcctttgatccgaaggtggatgagatcaagattacccagtatcgagtggcagagaattcggccgtgattaatacgctggtcagcgctgcccagaatggtaagaaagtgacggtattcgtggaattgaaagcccgtttcgacgaggagaataatatgagtacggcagagcgtatggagcaggccggtattcgtatcatttatagtattccgggcttgaaagtacatgcgaaggttgcggtcattcttcggaaggatacgtccgagggacttaaacggcgtgatttcgcctatttgagtactggtaatttcaatgagaagacggccaagatctattcggatatggcgttattgacttcgaatacggagattattacggatatcaataaagtattcgctgttttggaagggcgtatgaaagaacctactttccgccatttgttggtggcccgtttcaatatggtctcggaattgactggtaggattcggcgggagatcgagcatgtgcgggaaggccgaaaaggacggatcatattaaagatgaacggactgcatgaccaacatatgatcgaggaactctatcatgcgagtgaggcgggggtagagatcgatctgattgttcgggggatttgttgcctggtaccgaaccaaccttatagcgctaacatccgggttactcgtatcgtggatatgtttttggagcattcacgggtttggtattttctgaatgatggtcaggaggatcttttccttacctcggctgattggatgcgtcggaatttgaaccgacggatcgagacggctttcccgatccttgatccggatctgaagagggaaataatcgatatcttgaatatccagctaagtgacaacgtgaaagcttgttatttggatggcgagttacgtaataattttaagtgtgatgataatccggtaaaagtgcgttcgcaattggctatctatgattatttgagaaataaatccatacggtaaccgggatgggggagttttggggatttgttgattggggggctggttgcttagccttgatcgtggcggtggtatttagctttttgttgggagtacgtacgggacgtatccgggagagaaatgaatctgtccgttctcgcattcggcagaataaagcgaatatgtatcgctataaacaacaattagcctcctatcaagagcaagtcgtacgcttggagcgggaacgggattctctggtcatccgctcggaggcttatgaccggatcgagacggagctgacggcctatcgccagaagatggagcagttggagagagagatccttgttctttccggcgataataacttattggacaatgctaccggaaaagtagatgtggatgtacctaagcttttatgtgcccttaaagatgatcctctccatgtgaatccaagtaaagaggaatgggctgagattattggtatgaccgatcttctgtttaataacttcttaaccgatctgagaaataaatacagtattacccgccatgagcaggaaatatgttgcttgatcaaatggaatttctcccgaaaggagcaactagccgtgtttaataatactccggatgcgttaaccaaatcgaaaggccgtttaaaaaaacgtttaggcttggatgaaaagacggatttggatgcctatgtccgtttattataaagcttaaagttattttgtttgtcgtgattgtccggcaatattatccgtttatctcccattgcgtggtttatatgtgtgattattagttgtttgatgttcgcttgttttgtccggtaccatttctttcctctttacgatccttcctgtacttttgcggtgtgtgatttaatttttaagaacgaataatcaggaatactatgagaacacaaattgtactactatggatcagccttagcctaatggtggggctttccgcttgtgattggacttcgtcctctccggtggcctcgctacggcgggctaccggatggcctttcgaggtggtggttgtaatggatcgagacgcatggaatggtgaggtgggggagttgctgcaagaacaattgcgagcgccgatacctgctttgcctcaagcggaagcatctatgcgtgtcacctattcggagccatcgggcttttccggtttattacgatacgtacgaaatatcttgatcgtatccgtagatcctaatcggtatacgaaagctggaacaagagagagtcccgatgaatgggccagcggtcagaatgttgtgactctgtatgctccgactaccgctgctttaaccgagttccttttattaaatgaaggacggttggtcaaccatttcaatcgagtggaaagggaacgttggatagttggactttctaagagccatagcagttggatcaatgagaagttgaagtcccgtttcggtgtctcgctgttcgtgccggaagatatgtcggcctataaggaagagaccgatttcttttggggctcgaataacgcaaatcggggacggactgatatcttggtatatagttttccctatacggctcaagaggcatttaccgaagattatctggtcgctatgcgtgattctgtagtgaggcggaacgtaccgggctctttcccgaattcttatatgaagactgagaggcgcttcgagctttcttacgagccgatcacctaccgtggcgaataccgcggcgtattgcgtggtctttggcgtatggaaggagataagatgggcggcccgtttgtcagccatgccctgctcgacaagaaaaaagggcgggttattgtagcggaaagctttgtctatgccccggaatcaaaaaaggcgaacttgatccgccggatggaggccgccttgtttacgttgcgattcgtggattaggattgattctctcacgtatataggcgtaacctcatgcgtatatacgcatcggcctacacgtacgtaagtgtggtcttatacgtatatacgtgtggctttatgcctatatagtggtcttatcgtcctaaaaatagtttgatttcctccggaatatatcccgtccgtatacgccactcttgcggatacaggttattggctcggttgccaaggttctttacaaaacctagcggaagtccttggtagcgtaccaacacatatcccttatctgtaccggagggtaagacgagcgcctctttctttaagaatttaatagcgtcttcccattccagttccacggatggaaatgcgttgggggttaaggcagtacttaaagccagctcttgagatgggataaagtctttccctttcgcttctcctaggcaaataccggcggaaagtacccgtaaaggcttggcattgatgagtgaaaatagatccgaatgggctttgggatacgctcgaaggaaactgtcgttccattcgagagaaaatgaagtttcatccgaaaggaactgacgggcctcctgtgggatggacggagcggcttttcctcgctcttttttccctttggacttgacacgaatctcctcaatctcgccttccgctttccggagggcggcgaggaaaaagccttcgccccgtgtcttatgcgggaagaagcggtaaaccggatgttcaaaccggagggcgccggtgatctgccattcctcttgggtagggataggcaatgcctcggctcccagctcctctattatataatgtatgttctcctcatcctcttccgtattataggtacatgtactgtagatcaagatacctccgggtttcaaggcgttccagatatcatggatgatgcgccgcccacgggaggcgcaaagccgtacgttatctacgctccattcgcctgtgctatccgtatctttccggaacatgccttcaccggaacaaggtacgtcggtgacgatcacatcgaacagatgaggcaatgcctcgccgatctcctccgggtcattattgataacgatcgtgtccgggcggccccatttagcgatattctcggccaatacataactccggctgcggatcacctcgttactgactaacagactacctttcggcaataagctcgccagatgcgtggacttgccacccggggcagcgcataaatccaagcaacgtaccggctctttcacatatgccttgatcgcttgttccagaaacatggaagacgcttcctgcacgtaataggcccccgcatggaatagaggatcgaaggtgaaagacaaccgttccggcaaataaaaaccgctctcgcaccaagcgaccggagcacctgctttgggagcgggagtccctttggagtggttgatacggatacttacgggaacatcagcacttaacgctgcctctaaacgatcgaactcctcgccaagtaaagcccgtgtacgggtaataaaatcaataggaagtgccatgattattctgttagtttgcggcaaaaatactacttttgcggaaaacaaacagtatgcaagcatctcttttccttataccagttaccttgggcgatacggaacatcgccgtgttttaccagaatataaccgtgacgtgatcttatccatccggcattttatcgtggaaaacgtgcgtacggcacgccgtttcttaaaaaaggtggagccggggatcgtgatcgatgacttgacattttatgagctgaataaacatacctcaccggaacaagtagctggttatctagctcctttggcgaaaggcgagagcgtaggcgtgatctcggaggcgggttgtccggcgatcgctgatccgggtgctgacgtagtggccattgcccaacggaaggattatccggtggtaccgttggtagggccttcgtctatcttgatgtcggtgatgggatcgggctttaacggacagagtttcgcttttcacggttatctgccgatcgatgcttccgaacgaacgaacacgatcaagaaattggagggaaggatctattccgagcatcagacgcaattgtttatcgagactccttaccggaataataaactggccgaggagttgatccgtacgtgccgtccgtctacgaaactgtgtatcgcctcgaatataacgtgtgaggatgagtatatccatactcgtccggtcaaggaatgggcggggaaagttcccgatctgagtaagaagcccactattttcttaatctacaaataagaggattgatatgagttatcaagcgcacgagacagcggtaatcgataccggttgtgagatcggggaaggaacccgtatctggcatttttcccatatcatgacgggatgcgtgattggccgggcgtgtaatatcggccagaatgtagtcgtatcgccgggcgtggtcttagggaataacgtgaaggtgcagaacaatgtgtctatttatacgggggtgatttgcgaggatgatgtgttcttggggcctagttgcgtgtttacaaatgtaaccaatccgcgcagcgctatctctaggaaagatcagtataaggagacggtgattggcaagggggcctcgatcggagctaacgctacgattatttgtggacatacgatcggtcaatatgccatgatcggtgccggggcggtggtaacgaaggatgttccggcttatgcgctggtcgtagggaatccatcccgccagatcggttgggtaagcgagtacggccatcgccttgtattcgactccgaaggattcgccacctgtccggaaagcggccaacgttacagcctacacaatcaccaagttgtagagacggggcgtgccccgtctctacaatacagacaatattaatattctatacaaacatgaaaacatcttttttcaagcaagggtttttagcgatagggatagcctgttgcatgcagctttccgccgtggagaatcctgtagactacgtgaatacgttagtcggtacccaatccaagtacgaattatctaccggaaatacctatccggccacggccatgccttggggtatgaacttctggactccccagaccggcgagatggggaatggctggacctatcgttacgatgcggataagatccggggattcaagcaaacccatcaaccgagcccgtggatgaacgattacgggcagttctccattatgcctactaccgaaggcttggtctttgacgaggagaaacgggctagctggttctctcacaaaggggaagtggctacaccttattactataaggtctatctagccgatcataacgtgactaccgagttggtcccgacggaacgtgcggctaagttccgctttacattcccggaaaccaagaaagcgtatatcgtgatcgacgctttcgataaaggctcttatgtaaaggtattgccagcggaacgtaagatcatcggttattccacgaagaacacgggcggtgttcctcgtaacttcaagaattatttcgtgatccagttcgataagccattcacgttctcctctacggtcaagaacggagcgatccagttggatgagtcggaggtgaagacaaaccatgccggcgctatcatcggttttgagacaaaggccggcgaggtggtgcatgccaacgtggcttcttctttcatcagcaccgagcaggccgagctaaacttgcgtgaggtgggagatactagtttcgatcagctagtgaccaaaggtaaggaaatctggaaccgggaattaggtaagatcgaggtagaggatacgaacatcgataacttgcgtacgttctattcttgcttgtatcgttccttgcttttccctcgtagcttctatgagatcgatgccaagggccaagtcgtgcattatagcccttataatggtgaggtcttgccgggctatatgtttaccgataccggtttctgggatacgttccgttgtcttttccccttcttgaacctgatgtatccggagatgaaccaaaagatgcaggaaggtttggtgaacgcttataaagagagcggcttcttgccggaatgggcaagcccgggccatcgggattgcatggtcggcaataactccgcttccgtggtagctgacgcttatatcaaaggcttgagaggatacgatatcgagacgctttgggaagccttgaagcatgacgcgaatagccaactgccgagaacggcttccggtcgtgtcgcttacgaggagtataataaactgggttatgtaccgaataatatcggtatcggacaaaacgtggctcgtaccttggaatatgcttataatgactggacaatttatgcgttaggaaagaaactaggcaagccggcaagcgagatcgatatcttcaagcaacgggctaacaactataagaatgtgtacgacccaaaatataagttgatggtcggacgctctgataagggcgagttcaacccttcttttaaaggtacggactggagccgtgatttctgcgagggtaatagctggcattggagtttctgtgttttccacgacccgcaaggtcttatcgacttaatgggaggaaagaaggaattcaatcatatgatggattccgtcttcaagatgcctagtcgtttgggcatggatagccgcggtatgatccatgagatgcgtgagatgcaagtaatgaatatgggacaatacgcccacggaaaccaacccatccagcatatggtatatctatacaactattccggcgagccttggaaagcccaatactgggtgcgcgagatcatgcacaaactttataccgctgaggcggatggctattgcggcgatgaggataacgggcagacttccgcatggtatgtattctctgccttaggcttctataccgtatgtccgggcaccgaccaatatgtattaggtactcctctgttcaaatccgtaaaactccatctggataacggaaagcaggttttgatccaagcggacaaggctgatcgagagaaccgttacatcaagggtatgaaagtaaacggcaagacatacacccgcaatttcttgacacacgagcagttgctaggtggcgcgaaaattcaataccaaatgagcgatacccctaataaacagcgaggtacgcaggatagtgatcgcccctattcattctctttggaataagaaaaccttgatgcccattgtaagcatgttacaatgcctattctaaacaccttacgatgcccattgtaaagatcttacgatgggcatcgttgtttcttgtaaattaccgcttaaaataatagcggacgggaattgttttttattattgattgattacctttgtggtgacttatccgtctttcttaaatccttttatttattagatgtatggcaaactcaaaagagatgacggggggagctgtattccctcttctattcagtttcacgatgccattattgctcgggaacttacttcagcagacttattctttgattgatgccgctatcgtaggtaaatttcttggtatcaattcgctggctgccgtgggggccagtacctcggtgattttcttgattctgggattctgtaacggatgttgcgccggttttggcatcccggtagctcagaagttcggggcgagggattatgcgacgatgcgccgttacgtggcggtggggttgcaattggctacggtaatgtccgtggtgatcgccgctgtctccggtttctattgccgggatatcttgcgggggatgcagacacccgggaatatcttcgatggggcctatgattatttgtttgttacttttatcggtattccttgtacattcttctataatttgttggcaagtatcatgcgggctttgggagatagcaagactccgttctggttcttgctgttctctacggtcttgaatgttttcttggatttattctgcatcttggtactaggatggggcgtgatgggagcggctatcgctacggttttctcgcaagggctttccgccattttatgttatttatatatgcttcggaaatttccgatcttacgggctacttcttccgaggatcgaaggtttcatgccgggctggcccgtaccttattggcgatgggggttccgatgggattacaattttctattaccgctattggcagtatcatgttgcagagcgccaataacgccttgggcacggcctgtgtcgctgcctttacttccgccgcccgtatcaagatgttcttcatttgcgcttttgagagtttgggtatcgccatggctacgtattgtggacagaattatggggcgggaaagccggagcgtattttgcagggaattaaggtaagtgcgttgatgatgcttacgtatgccgctgctacatggatgatcttgatgctggggtctcgttggctggccttgttgtttgtggctccatctgaggtcgaaatactggactatacggagcagtttttgcatatttcttgctggttcttcccggctgtcgggctactgtgtatcttgcgttacgcgatacaaggggtaggttttagcaaccttgcgatgctctcgggtgtttcagagatgatcgcacgtatcttggtgagcttgtatgcggttcccgcttttgggttcttaggcgtttgtttcggtgatccgttggcttgggttgccgctgacttattcttgatacctgcgtttttgtatgtttataaaaagataaagaaaagattagatgatgagaaagtatcggtgtccgcagtgtgatatcccttctatgtatgtaaagaatgcggctggggaacgtcttttagtgtatgtttacgagaatggggaggtcgttcccaaagaccctgccgcggatctgtccggatttgacttgacagaggtattttgcctaggatgctcatggcatggagcacctaggaaatgccggtgatttttgtatctctatcctctcggaagtgataggatgcgtgaatgctagatattcagcgtgcagatagagccgttccgcctttcgtccgtaaagctcgtcgccaaggatggggcaatgaagacctaggggatgggcggcgtgtacccgtagctggtgggtacgtccggtttggggataaaaggcgataagggtttttccggaagtccgttccaatacccggtagcgtgtaaaggcaggtttcccgaattcttcgcttacgatttgccggggtctgtccaaaggatcgggacatagcggaagacggatctcaccctcatcttggggaacttcaccctctaataaggcgatataccttttctggatggttcggttcttgaattgggcttgcaggttctgatgcgcttctttggtcttggcggcgagtagcaagccggatgtcgccatatccaagcgatgtacgataattgggccggtggcatccggataaaggatacgcagcctgtgatagacggagtctgcgtctcccttgccggggacggagagcatacccgccggtttattgacgatcaacaaatagtcgtcctcataaaggatatccagcttcgtctcccggtgagagtccgccaataacggattctcatctacctgtaatccctgtagcatatggttgaggatcggctcgcattttcctttgcaagccggataataatatccatggtgccggatctccgtcttgggagaatcgccccaccagaactctgccatggcgatcggctccaactgatgctggtaggcgtattgcaagagtttaggggcggcgcactcacccgctccggcaggcggcgcaccttggtaggtaggggcgaacagttcgcataagtccttcacttcgctccgggcgttcaggattcggaattgttcgaacaacttgcgttgcaaggccgccgaccgtcgcttgcgttcttgcttcagttgctcgatctcctgctcaagccgatccaccttggcttgatcctcctccagtatagaccgcaatgatttcttggttagcttgtgagcggctttcatgtgttggctctctttaataagaagtgcggtctcttcttccgtgagagggaactgccgaagtcggtcgcgctcctctttcctctttttcatcaagtcttttgcggcctgtaatacgaaatcgcagtattcgatcgtgctttgtaacctcgaccgtgcgtcttcgagagctggagaggcttgcagggttcggatacgggcattgacctcattgatccgctcctcctcttgccggaagaaaccatccggttgtaataggtcatagatcggggggacgaagaatggatgtacattcttccctgctaggttaccggagaacgcggccagatagccggcctctccggcgggagtacgaaccaccaatacgccgaacatttttccggcttgtaactcttcccgccattcggttcgttctttcaggtatgcctgtgtttcctcagccgctattacgcatagaggatgcggtgtatagtgaaaaggatacgtgaatcgttccggtaaggggatcgattgtatcggttgggcaaacgtgtgaaacttagattccatcattcattttttaatagacaataagcgtaaacggccggtgccgtaggatctccctcttgatacaatcccggacgggagatacgatcccattggatcaacgaccgggtctctttcgcggagagagcttcgctgacgatctcgttccatgcttgtccgtccttactccagtagaacgtgctatgcgtaccgtcggtcactttcatccgtagatataaaggcgaggcgggaagaggaagatcggccaatggatgttctttcccctctaggatatatttcaatatcaaacggtctccagcgcatccgcaggtgattaggttatttgcgtctccgtacatcgtgattcctttccaactgtcattccggtttacgatcgctgtttccaacgtgtaatccggggaggttgggcgtaaacaaagtgccgctccggtctttacgccgggtttcggtgttccggatagagatagtttaccgttcttgatctcggtcttgacatccgtgtaaggatagttccaactccattcgggacgcaaggtagcaccggtgaaatcatccgagaaatcgaataccggcacttgtgcggactcggcaaatggcatgggttgcgtgcggctcgcgtattcctcggttacgaagtgaggccaatgatcctcacccattctcacctcttgcaggtaaggttggcgaccttggtagaagccgcttcccggctggtaagcgtggcataggtaatacatgcgtccgtccggtgtagtcgtaatcgttccgtgaccgatggagagaacctccttgcttccgtgcaagatcgggttcccttggtatttctcgtaaggaccttccagctttttcgagcgagccacggatacggcgtaatcgctctgcgggccgcaacagcctctcacggagtagatgatatagtaatatccgtctttcttgaaccaatgctgaccttccataccttgacgctcatcgtcacgcagcaggctgaaaggctttccgtctaggcgaagcccatcgtccgtcaacttacaggccaataactctatgggttggttatccaatccataagccttccaactgatgtaaagtttgcctttgtcctccaagataaatgcgtctatcgcttccttcccaaactctaccaccgggccgtaatccttgaacttgcccgtaggtgaatccgccacggcgacaccgatgcacgagatgttatccgattgcttccgggccgtataatagacatataccttccctttatgctgataccattccggagcccagaatgaggatttagtccattccggcttctcgtcgaatacatgtccggtttgctgccagttcaccaaatcggtagaggtgaaaaccggataataaggggcccattccgaggaggtgccagtgatatagtaagtctggtcgatccggataatggaaggatcggctacgtcaccgtggatcacgggattggtaaaataggattcttgttgcgctagtcctgtggccaaggaggcggcacagaagaatagtgtgaaaatctttctcatgttttatcgtattttttttaagatattcttacgtacggttcgcaaagagatttgtagtaaatcgggttccgccagatcaagtagtgtcttatactcctgtaatagctctggaatgggacggcataactcatatcccagtttcatgcaaagcgtttgcacaccgggtaattccttcgctgaaagcatccggtctaggcagaagttcaggaaatccacccgtgggggattcgcttgaggctgtcgtaaaagcaaattcaatagaagacgtcgtttaccgggatgcttgcagaccagaatctcgtttatcaattcatcttgtttatcgtatagccatttattcttatctgcggaaaaatggctacaggcccataacgcttgataaccgatggtctcgtccggatcgaagatcaaaccgtatagttccgatttccgtttctggcttccttgcacatatcgcaatatctcatggatatcctctatgtggatgcggtcagataatctctctcttaaatccatttacaatattgaatcttatatctttcgatcttttatgccgtaaagttatagtctttttagcaaactttctctaattctcttacttttgttcccattcgtttcatcggcgtatacttcatcccatgcgtcacttgttcctcacagacaggctcgaatccgagctttctgtagatggggattgcgtaagaagaggagttaaccgtcatttctgatacgggctgatttaagatcgcggtcttgaacaattgtttaccgattcctcttctatgataagacggtttgataaagaataaggagatatgttttccctcgttttttgtcgcgattacgccaattaaagactctccatcgaaggctccgtagaaggttaattcatttactagttgcttattataaatgaaattcttgaaagtttccagcccctcttcatcgaaatcctttcttccgcattcgatgaaaacgtccagagataagtctaatgccttatcgtattcatttgccggtaattgtcgaatttccatagatatgttattctttttgattctcttctagtttcttatctgctaccaattcaaaatgatgcgcatcaatgaattgtccgtttttgtaacaagcctttctgaaaatgccggtcttcctgaatccagctttttctaatactcgcatggaggccggattatattcgtagaccgtggcgaatatacgaataacctccgtatgcgcgaaataatactggatggcctcggttaacgcatccgaaacaattccttgattccagtatttctcactaatccaataacccacttccgcattgaaacgctctacgtccgtacctctcacaaaaccaatgttaccaatagcctcgccaccaaccgtaatacaaaaatccgatatatctgttttctcctgcgcttgtttgatgaagaagcgggcattcccttttgtataaggataaggtaatccatcccggcagttatcccagattttcttattgttcaaatggaaggctagggattcggtgtcttgatcttcccagctcttgagcgtatataaatcctttattactacaatcataagatgttgtttttacgggataaggacggattctcaagataatagcacaggtggtcatatatttgcccattatacattaactctgcttgatgaagccgtccttcgtatatgaatccattcttctctaatacacgttgtgagcgttgattgtgaggataacaattcgccgtgatcaaatgtaaattcatttgaatgaacccataattcaatacggattgcactgcttctgtcatgaagccttgtccccaacactcttcttttagccaataacccagcatgcgagcatgtgggttttctcttttggaatcaggaatgatgccaatggagccaatgacttgttttgtctcttttgatacgatagcccaaaccccttctttcccgataaaaatggcatttagaacatcgattgtctcctcgatcgtttcatgaggtttccatccggcgttattgcctaggtttggattcttacagctctcaaaaacatcaggagcatcgctttcgctgaaaggacggagcacaagacggttggtttctatgttcgatgtttgtgtcatatacggatgtttatttagtcgagatagatcattttcttggtcatcccaccgtcaatcgtaatattctcgccattaatgaaatcgttttcctcttgacagagaaataagcacatacgggcgatatcctccggctttcccacccttccggacggatgttgagcatgatcctccggacgaagctggtcgtaattgttattctgtatccaaccgggagcgatagagtttaccgtgatatgccattccgagagcgataaggccaacgcatgtgtcaaagaatagatacctcctttagaggcggcgtaaccctcgctaccgggttcactcatcaagtaacgggtagagcagatgttgataatcctgccgtatggattgggggtatcgagagattgccgatggagcgctaattggcgggaggtgataaacgccgggcgtaagtttatggatagtatcttgtcgaaatcctctacgcttgtttccgtgatgagagagaactgactgacacctgcgttgttgataatgatatcaatatctccccactcctcgatgatctttcgcaggcaatcttctagtgcggttttatcactaacgtccacgagatggaattgtgtcccggtttgtagggcagtctcttttcctaaggtctcgttcttgtcgcagaaggccacacgatgtccggctcctctgaaagcccttacaatcgctttcccgatcccctcggctccaccggtgatgaagactcttcttgttttatgaagtgtcttcgttgtatgccccgttctagtgccggaagtcttccgggcttggtattctgcgtacttattttccagataattgtctgccatgattcagtcactattaaatgaggacaaatatagttgttttctgtcgaaccgatttcttttagtcgatattctgtttgggatactaaaatagaaccggaaattgccatctaaattgcttgtggatttgttttaatagaaaagtattgattatgagaatagcgatcagcggggcaagcggatatatcggtcagcatctttcatcttttttggagggaaaaggatatgatgttatccctttagggcgggatttgtttaaggaagattgttttgatgaattatgccgatgcgtggaatcctgtgaagtcgtcattaatttggcgggcgcttccattaataaacgttggacggaggcttacaaacaagagttgtatgatagccgtatttgcgtgaccagacagttggtgcatgccataaacacgagaagcgtgaaacttgagttgtttatttcggcctccgccgtaggttattatccggctttcggggaatatgacgagtatcatgattgccggggaatggattttttggcccggttgtgtggggcgtgggaggaggaagcgtccgcatgctcatcggatgtgaggcttgtcattacccgttttggtgtcgtattgtctgaggatggaggggccttgaaagagatgcttcgtttgcaacgcttctcacgggtaagtgtcgtgatcggtaacgggcaacagcgttttccatggatcagcctgtttgatctatgccgctcttttgggtatatcatacggaataggcagatgaggggtgtggtaaatttggtttctccagaccttatcacccaaaagcagttggctcatacgttagcgagagcggataagatccgtaggatcatccctttgcctgagttcttttttcggctgaagtttggcgagggagcgtcgttcgtgacaaaagggcaaaccgtccatccctctaaattacaggaatctgggtttacatacatttatccaacaatagagaaacttatgaatataacagatcatcataccgtaccggaactggatgttaaacggtatatggggcgatggtatgaaatcgcccgttatgagaatcattttgagagaggcatgacggatgtgacggccacgtatacgttgcttccggacggaaagatccgtgtggagaacgaaggatataaaggcggcgttcacaagaaagccaccggtcgtgcgaaacaaccggaccctaaaaataatcccggaaaattgaaagtggctttcttcttatggttctatgcggattattatatcttagaacttgatgcggattatcaatatgcggtgataggaagcagcacggataaatacctctggatcttgagccgtgagaggaacttaccggaggcggttcgggaagatttactggggaagataacggaacgtgggtatgatatctctaaattgatttcatgagctgatgtataaaggggtaaagccgtagtgattacgcctttgccccttttattactcatattggaaaacaatcttaacagaggcgatctgagagagttccttttgctcacatgataggctttacgatttcaattttaaggccaagcgcatcaataatacggaaaaataaaccaactcccggttctatgattcctttttcaattcttgatatataggtcttattagttcctactttttcggccaactcggattgtgtcattttctcttgcttccgtgcgtcactaataatttgccccacacaataagagtatgcttctttgcgaaactcctctctttctggtgagccaaccttgccgtataatttatctaatacagcgtccatactcccgatcttaggatttgcttgcataatattcattttttttccatagtgcaaatataaattaagtttacatatataacaactttagatagacttttcttttatgttttcagttgcttcccatcggaaaaggcatttcctaccttttcgcccactctcaaatagtcgttgttgaatggatcaaagatgatgggagcggctttagctacattcaccttgccgttctcatcaagtacacgctcgtcaacactgacatttacgatctcgccacggagtatgcaagtatccggatcgtaatctttcaatttacattcgatagccacggccaattcgtcgatcaacggagcatctacgaagtccgattttgtagcgtgaaatcctgctttggcaaacttgtcggtaactttattgcccgacacgatacctacataatcacaagctacgacatgatcggcatctgccatgcttaccgtgaaagctctacgcttcaggatattcttaactgtcttgtgaccggcgctaagacacatgctgatctcattcatctcactgataccgccccaagcggcgttcatcgcatcgggagttccatcttctccatacgtggcgataataaatacgggttgcggatagctcaaaggcttcgctccaaaattctttctcataatcatttattttttagtccaattcttgatatcttcttctgtcactccgttcatcaacttccctttttgccagttcacatccggataggctttccgcaattcgctctctgcgttcgagatactgctgctgcctgatgtggcgaatgggataacggttttacccgagagattgtatttttccaaaaaggtgttgatgagtcttggggcttgattccaccagatgggaaatcctaggtaaacggtgtcatactccgctaggttcttcaaatcatcgataatggccggtcgtgatgtaggatcgtccatctctacgctgctgcgtgaggatttatcccgccagttcagatcggcggaggtatagcttttctcaggttggatcttgtgaagatcaccgctgacaatagatgcgacttgttgggccgctttttcagtatttcccgttgccgagaagtaagccactaaaacttttgtcccttcggcagccttttgcgcataagaggcgatacataccattgagaccatgaccatgaataatacgattcgtttcatacttcttgaatttttgttgtttttatattcattacgagaatgctatgtatttatggcgataaagataggagagaaaaatgaaacagtttgtacccaaattactgatatatctgatatttttggcgatacgatccttatctttgtaaggcgattaactaaaagaagaaaatatcatgcttgcgtacacttatattgaacaagggaaatttgaattgcgggagaaaccgataccggaaatacaggattcatgggacgctatcgtacgtgtgactttgggtagtatctgttctagcgatcttcatatcaaacacggtagcgtaccacgtgcggtacccggaataaccgttgggcatgagatggttggtgtggtggaaaaggtgggtgccgatgttactgcagtcaagccgggtgacagggtgaccgtgaatgtcgagaccttttgcggagagtgtttcttctgccggcgtggatatgtcaataattgtaccgatcccaatggcggttgggcgttgggctgtcgtatcgatgggggcaggcggagtatgtccgggttccttatgcggatcgaggcttgaatcgtatcccagatacggttagcgatgagcaggctttgctggtcggtgatgtgttagcgacaggtttttgggctgcccgcatctcggagatctcagaggaggatacggttttcattattggcgctggtcctacggggatctgtactttgttgtgcgtgttgttgaagaagccacgacgtattattgtttgcgagaagtctccggaaagggcccggttcgttcgccagcgttatccggaagtcttggtgacagatcccgaaaactgtaaggaatttgttcttcgtaacagcgatcatggcggtgcggatgtcgtattggaggtcgcggggagtgaggataccttccgcttggcatgggattgtgcccgtccgaacgccattgtcaccatcgtagccctctatgataaacctcagcttcttcctttgccagacatgtatggcaagaacttgactttcaagactggtggggtggatggctgcgattgcgccgagattcttaacctaatagaagaaggtaagatagacacgacgcctcttattacccataagtttccattgagcgagattgaggaggcttaccgtatcttcgaaaacaggttggatggggttataaaggtggcgattgaggggaatctcatcaaacctgtctttgttttgccgcatacaccttgattctctcctcgcaacattgtcgcgtgatatcccggagccgttctactttgggtataagcgcctcgatatcttctttagtgacgcggaagtgtaaattataacgagcttgaacgtatgcgtcctgcagcaagtcgaaaagtcgtttctcctcttccgtatcccggggaaaggcttcggatgactctagggaatgcgttttggctctgccggataacgttattaggctatgctctttgggactatacaatgtaaaagtcaagattatgctgttgtaataattctcacaagcttgatgaaggtggaacgatgctattttgtaatcctgatccttgtatgaatatcgggcactacgtaagaaactattcgcacgttcaaacctgtcgttgtaatactcctccgccaactcttttatttcgcgatagttcagtttacgacggcgggccagcttataacgaccgctgttgtaaagcatgataccctctcgcttgatatcagtatagaaatatcggtttttatcgatggctttattcagatcgtcgatgctctcgtctataaactgtacggtggtggatacgtatctgttcttccctttgtagtaattatcggtggccttactcaagatgtgattgataatatatctttggaaacgggtactggtaactaccaaaatatcataatcgctcataaaacaggtgcggataccgtattcgatgcgttggtcgtagtcaacgtatgtattccgggcataacttccgtagagaatgatcatctcacaatcgggaagtacttccagtacgcactctacaattcttctgaggtcatcccgtttctgttcgggaaggtaattgatggatgttttcattcttcgtttatctatgcaaattgtttgtaatcactttttactttcaatgaacattgttctgtcccgatagcctttacgatagctaaaagcggtgcgctgaactgttcggttagcttgttcggtacttgttcggtcgacttgttcggttggctgttgtggggtcatgattttctcccatcattaagtttctgaaaaatgcgatcaagaaactcatatccggttcaacgtcttttcgcacatttctataattcgtacgaaccagcgcattgcggaagtaccaagagttgtcggcaaacagatcattgttcacgtcaaaaccgatgctacgtaaatgctttatagcaaagaccgccgtagtacgagtgttatcctcactactacggatgtatgatgtgaaatctatgtccatatgtatccaatcatgattataaacaggcaataaagatataaaatatcctgctatgtgatagtgaaaagatgaagaagttgtattggctcggtcttttacgtattatgagtttcctgtaacattgaatttataaaaatatctacaatatctaccactctattatatactttttgtaaatgagagtattatctgttggttgtagatgtccaaacatctacaattattattcaatatctaccatttattattgatttttatacaattttcttttcgtgtgaaggaaaaaagtgttatatttaaagaatactgaaaatctaaaagatatgatagaaaaactcgattacgctatggtgccgacaggctttgtacattgttttaatgaaaattgtaagaacgccaaccgctgcttgcggcatcaaatcgtccgttttatccccgatacgctttgggcggtgagcatcgtgaatcccgcacgtaccagtcctaccggaaagtgtgcggctttcatggcggatactcccgtgcaatacgctgttggcatggatcacctattagaccagataccttatctggaggcgaaacgcatcaagcaacgtctgttgatgacatacggtaagaataagttttatcagtttaagcgcaaggaaagaaccttctcgcccgaagaccaacagtatatccgtcaggtctttcgggcgtacggagtagaggatgaaccagtctttgatgcttggcagagtggctaccgatggacgaagggataagagctgataagagtttcccttaggagaacaaagagtttctcttagggaaaacaaaagtttctcctagaggaaacaaaagtttctttaggaagaaacaaaagttttcccctaataaaactttagtttttctataggaaaaactgtaagcataagttattcaacttcttaaataatatattagacatgaaaataaccaagcaaacagcctatcgacataccgtcgcacaacgggcgatgcgtatggaggagatcgtggcatgggtaaaggatgagcggacgagggataagcttgcgctctttcgagagaaattaaggcgggcttatcccgacaaacggtatccgtttacccggaaattacctctgttgctctttgccggaacttttcgaaaaggcgagttgaaggagtataatggctggattttgctggagatcaatcgattgaagagcatagaagaggctttgtccttgaaacaaaaaatagtggaatatccgcagacactgttcgctatgatcggctctagcggacggagcgtgaagttcgtggtggcttatacctatcccgacgggtcgcttccccgttcgcgtacggatgccgaggtttttcatgcgcacgcttaccgacatgcgctcaagacgtatgagcctcgcctttcttatcccatcgagctgaaacgtccggtgctggagatgggctgccgcctcagttatgatgccgatgtgtattacaatccggacgccctttccattcatctggagcagcctgtggctatgcccgacgaaagcgcctaccaggaacggttcgaaaaacgggtaccggtactggtagagagtgccgggcagacgctttatgaccaataccgttacgttgccatccaatatgaattcgctttgcagcgggctttggaggaacatggaagtttgagcataaaggtggatttcaaacctttgttggtcactcttggaagactttgtttcgcggctggggtagaagaggaggattgtgtgaagtggacgatgctttatttggggaatctgatctcggaagtggagatccgggagaccttgaggcagtcgtatcggttagcctccgattcggactttggttgtacgtccctttacaagccggagcaactacagagcttgaaaatggaggagtttatgaaccgccgttacgatttccggtacaatctgatgtctggcggaccggaatatcgggagaaaaacaccttctgttttgactatcgccccgtgacggatcgtgtgctgaacagtatcgccttgaatgcccagaaagaaggattgcagctatgggacagggatgtacggcgttttgtcttttcagatcgcatcccggactatgcgcctatcgaggactatttgacccgcttgcccgtgtgggatggcaaggatcgcatccgtccgctggccgcacgcatcccttgcgacaacgtacggtgggaacagttgttttacacttggttcctgtcgatggtagcgcactggcaggggcgtgacaaacagcatggcaacagcctttccccgctcttggtgggcgggcagggatgcgggaagtccacgttctgcttcaacctgttgccaccggacttgaataagtattacacggacagcatcgatttcagcaagaagcgggatgccgagctgtatcttactcgtttcggattgattaatattgatgagttcgaccaagtgagcgcgaggcatcaaggcttcttgaagcatctgttgcagaagccggtcgtaaatgtgcgcaagcctcatgctacgcaggtggaatcggtgaaacgttacgcttcctttatcgctacgagcaaccatacggatttgctgggcgatccttccggcagccgccgtttcatttgtatcgaggtgaaagggatgatagacaatgcccagcctatcgattatctccagctctatgcgcaagcggttgccgccttgaataataacgagcgttattggctgacgcatgaggaagaggtctcgcagatgcaagcgaacgaggcgtttcaacaacgtcctttgttcgaggatctgttttttcaatattatcgtcccgcttcgcacaaggaggaaggtttgaagatctctgccggagagatctacctatcgctgcaaaaaaagagcggcgtaaaacttccgatgagcaatgtctccgtctttggtcgcttcttgaaaaagatagggctaatgacacagttggcgagtaggggacggttgtatttagtggttgaaaagtagtaaatggtggtagatgtaagttgttggtggtagatgttttattatctaccaccattagataagtgatttatcccacttctggatcttcccaaacacctgttttgttcattcgatagcttctctctatcttttgggaagagtctgcctccagcgcatagagtatttcacgacagaactccagagttgcaaatccgttggcggtaataatgtttccggctctgacagccggttcatccatataaagattttcacctgtataattaacccccgcaaattgtttgaggtaatccaatccgttgctggtatgatttacatggttcaagaaaccgtgtataccaagaaaaacggaggcgttacaaataccggccaccagcctcttcttctcgatggcctcttttaccagaggaacaatggcttcggcttccggggtgaaccagctcatgccacctattaatacgatccctgcataatcggccggaatgtcatggatctcatagtcgggcagcaccttgaaccctccgatcgatacaaccggctctttcctgatagatacggttttaactatatatttgctttcacttccgggctcaacacctaaattgaggttgggagcgatataagccccttcccaatcggcaaagtcttttaacaagacgaatagaatttcttttttcattatttattgtatttatcgaagttatacttctttctaatctcgttttgctcgtcaggcgaaagagatttgaaatatcctttccaacctgggcagaagtttatgtgccaacgccaaaagcgtcccattaatgactgaggacttttatcgtattttttccttagggggcagttgttgcagttacttttttgcatggatgttacagaatgcttgttgtttacaaaggtagtgcttttattggaattgctttatttcaatctttgtttattatgataatataccccatctgatataattgccaatatttatcgtaattttgtatccgaaatggtatacgaagtgcatctatcagccacggtcaaaatgttgctgttaagagaacggattggcaggttttcatcgaaataacaaatatagaatactgattatatattcgtgtaggtaaggaacccccttgcaggcttcgtgaagtgatgaatgtttggagctttgcttagaaaagttcgaaagaatacagcaactagacaggtcattcaaaaaagttagcgaatagttaattggttctcaataaaattcagtatttttgcactcacaattgaataaaagcaattagcaaattacaatgctgcagaatagagtgaacatattagtaaacacattatgtcgaagcacagtatgctttgagagtatgtcgtatgttcatactttaggcattgagtcattcggtaaattcaaaaacactttccagcgaacgttttatagacaggtaggagtacattaggtgcaggtattcctattaaaaagataaattgaagccgttgaaaagtccttactaaatttttcaacggctttgtttttgcccattggtgacgttcgcattatgcgctctactccgtcatttccgtccatgggcattgaaaacttcagttttattaaccagcgcagtgatgtgcataaaaaaagaagattatggattacaaattcaacggaagcggggtattctttacatctgatacccacttcaatcataccaatatcatcaggttctgtagcaggccattcaaggatgtagaacacatgaatgaaacacttattgccaactggaaccgtgtggtcggtccggataatatcgtatttcatcttggcgacttctgtcttggtggctctgctgaatggacaaagatactcaaaaggttgaatgggaaaatctatctcatagccggtaatcatgacatgaagaacttgaggcagaattatacaaaatatttcgaactgatcacgatgcagatgtacatcgaggtggataaacagaagatttatctgaatcattgcccgttcctttgctatagcggctcatacgatgatacctggcagcttttcggccatgtgcatacaagcaggaataacactggaaaagataagcctcgccttcaaatgcttttttctacacaatatgatgtgggagttgacaataacgacttcactccggtttcattcgcacgggtaaaggctatcatagagaaacaggttgaactatcaaagaaatgagaatacgatacatgagtgatctgcacctatgcccacttttcaggtatttgcgccttgtcataaagattcggtgctgaacagtgcctttgcgagtaactatggagacttgataagcaacaaccggattgatgcctggatatacggtcattcacatacgaatattgatgcagagattggtggaaccaaagtattatccaatcagatgggatatgttttccagaacgagcatcttatgaatgggtttgattcgggaaagtatgaaaataaagaagatttttttcgggattggcattcattcaacccgatggaaacacgctggtttcatgtcgcttcttccatatacatggagggaagggcaatccggtttacagaccggaaatatacccgtttcgttgtttcaaattattcttcgtatgtttcggataataatgaatactataacgatgaatggcgcagggaaactattacccgtatttttgcctatctgcgcagactggtggatgccgttattgccgatgctgatggcttcaatgaatatgtagccggcaatcttccatatcagcaacggacaggaaagatagcacggaaggattttaacaggatagagccgcgattcaggattgagtcgaaagacagggaaacttccataaaagctttggaagattccgtgaacggacgttctgtgcctccattagagactatgaaggtagactaatgtcatatttcatgtgttaacgcacatctggcaatccgtttggttagtcagtaacatgcaaattatcggcactgattcgaaatagtgccgataatttgcataattctgatatttcaaatatgacttaatcaaattctaactaacaggcattgttcgatgcaatagaattccctacgatagatgaaagaataagaaatctttctaatatgatggattggatgagatatcttccatcagtttcattaggtggagatcaagaatcgtattcaataacgaaataataagttatagagtaatggtgtaagattctattagcatatcgaggataatttcaataaacttggagttcgttgataataacttctagagttgctgaaataattaacgaggatatttttctaacattctaaacggaatatcatttgtagtaacttcagctatagatattttgtttatatttagctgtatatcattattataatatttgtatgtattcgcaaataagagatccaaacagcttaatgaaatgataattgtcgatgagcatgtttacatcactgattatcagtgacaattcaatttaatcggtacaacctttgttttgacaaatacacagaacgtggggacaaatgcagaccgttgtatttcactgttttgcatatacgtgttgtaccgtcttttttcagcccttttgtggaatgtcctttgtcagatacaaggtattgagtgataaggtatttccgcaggtatgttacagaacgttgttgaatacagaggtagtggttttctttggatttctgtggtttgtggtatagtttttattttccaaaaggtgttggatagtagaaaattggtcatagaaccagaaaacttttgtagaatttacatttgattcgcttaaaaaagtgtagggaaatgggtgatattcgtttgggaaagtgtaaaaacatatgcgttgtacttgtcttggccttaatataaacgactcaagctttcttaaattataccctgtctaatataattgtgctgtcgaaataataaattatacccatgctgatataatatcgaatatttgtgctatctttgtacccgaaaaggtataaagtatgatgccatgaataatctttcaactacggtcaaaatgttgcgaaagcaatataagctgacgcaagaggaactctcgttgaagtcgggtgttgggttgcgctttgtgcgagacctcgaacaaggaaaggaaacgttgcgccttgacaaagtgaatcagctccttgactttttcaattatgaaatggttgccacacaaaaaaataataatcaatgagacaagcccatatattttacaaagaccaattggctggtattctgacagaaaacgatgccgggtatgagttccgctatttaccggaatatatctctcatgaaaaggcaaaggcggttagcatgacattgcctttgcaagacaaagcatatacaagtcctgtgctgtttccatttttcgacggtttgattcctgaaggatggctgttggatgttgcattgcggagtacagacatcagtattcttgaccggatgtcgctcttgctgacatgctgcaaggattgtatcggagccgtaagcgttattcctttggaagaaaaggagggaagccatgtgtaattgcttatattgttatcgtccgctcttaaaaggggaaaaggatatgcacacagcttgcataaagaagttcttcggaacagcaacactgcctgttcttgattatacgacagaacaacttgatcagcttgctctgcaaatcattcaagaccaaacctctttgaccggtgttcaaccgaaattatccttgcatttgaaggaacatgagggcagcaaacgattgactattgtcgggctatggggcggttatatttgtaagccacagacctcgcaatatgaaatgatgcctgaggccgaggatttaaccatgcaccttgcagaggtggcacgtattgaggtagttcctcatacgctgatgcggatggcagatgatacgctatgctatcttacccgccggattgacagaacttctaccggagagaagattgcgatggaagatatgtgccaactgacagaaaggcaaacagagcataaatacaaaagtagttatgaacgtatcggtaaggctgttttgaaatactcgtctttacctaaaatggatgttactaatttcttagagttggtgcttttttcttggttgacagggaataacgatatgcacttgaaaaacttctctttgtatgaggtggcggatatgatacgtttgactcctgcttacgatttgctaaatgctactatcatcaatcccaatgatgatgaagagttggcattaaccttgaatggtcggaagaaaaagcttcaaagagaggattttattaggtcggcagccacgctgggtatagagaatgtgattgtagaacgactgataaataagtatattaaactattgcccaagtttgagactgtcattcaaaactctttcctaagtgctgaattaaagaaaaaatatggcaatttgttgaaggaacggcttgcgaggctttcgcagaggctataaaacggtaaaaatacacaatgctatggatatattaaatctcatccaaataacatcattgttcatcctaactttaatagaaagagacgatggacaaaagaaacaaattgtggagacgccaacaaatggctcgtgtgtttaaggctcgtatgattctgtatcccgcttatggtcattgcatcattcgtgaggatggaagctattatgaacatcctcattggtttgagttggaaaaagacaaatgggcgcaagtctacaaaactacaggaactccgtgtggttgctggatgtgcagaggatttgaatatgaccgcaaggagtataagaaagaaactttgcgtattattcgggaatcaatggagtagtttaaagggataggaactaaatctgtgcattatgtgcacaggttcagttccttgcttttcatgtaggattaagaaccactaccgatattcagaataaatatcttgcaatgtatcataaaatccccatccacaattcgatatgctatcaataagcttttcaatccgttcgtaataattggctaacaatagcataaaaagaaaagccactggtttttagcggctttcttctaattggctatggttgtttatggctgcttacaagccatcattttccgatgcaaaaataccgaaatatattctgcaacacctgatccgtcgtaacctctcctacgatatccgataaatggaatatacactcccgtaaatcttgcgagatgaaatccccggaaaggctggagttcaaaccttcttgtaccctatgtatagcttccagcgcatgcgtaagcgcctcgaagtggcgggcattcgttacgatgatgtcgctttggtggagggtggggatggaagatacttccgtgaggagttgttgtagctctgcgatatgcagcttgcctttggcggaaatagcgatttgatgccagccttcggtggggaaagagaaggttgggagagaggatgtgggtaatacatcgcatttgttcatcgctaagataacagacttattcgttaatctcggagctatttcttgatagaaagcctcgaaatccttgaggtcacgggttaagtcgtacatgaggatgacgatttgcgcttggtctagagccttgaaactacgttcaataccgagagcttcgatcgcatcgcttgtttcacggataccggcggtgtcgatgaaacggaagagctggccgttgatattgatcgtatcctcgataacgtcacgggtcgttccgtggatgtcgctgacgatcgctttatcctcgttcaacaaggcgtttagtaaagtagatttgccggcattcgtctcaccgatgatggcgacgggaataccgtttttgatagcgttacctacgctgaaagattgggcgagtttggagatgacctgttcgatatgatccgcaagcgtgcgaagctcgctacgatcagcgaactctaattcctcatggtcactgaaatccagttccaattccatgagagaggtgaaatggagcagttggtttcgaagttcggcgagttccctactgaaaccacctcgcatctggcttagagccaaacgatgttggccggtcgaagtggaggcgattaaatccgcaacggcctccgcttggctaaggtccatcttgccattcatgaaagcacgttgcgtatattcacccggttgcgctatacggcatccgctggagataagggattgcaggatttgttgttggatatacgtcgagccgtggcaggtgatttccaccgtatcttcccccgtgaaagaatggggggcacggaaaacagcggcgatcacctcatctatggtttcgtcattgttaccgacgatggaaccatacgttaaggtataagccttttgggtagataaactcttacctgccttcttcggccggaatatccgatcacaaatcttgaaagcatccggcccggagacacggaccactgcgattcctcctactcccggagctgtagatatagcgcaaattgtactcattccgtctattaaaccgttattaattcatacgcttgagaacccagtccgatttcctccgcataacgtaggccggcttgccagttcgtatccggatgaatcaaatggaatttatcctctccctcaaggtgttcgtgaggatgagtctcggctaatttattacctccgatgataggagcgttgataaccatatcggcgcaagccttatccaaggccaccggatcgaaagacgcggcgatccccaaatcagggatgatggcggcatcgttatgattccagcaatcgcattccggagatacgttcatgataaaactaacatggaaatgaggcttgtctgctaatacggctttcgtgtactcgtcgatcttgtaattcaatcgctcggaagtatcaccttcgcccattacggcaccgtcgtactggcaaagagccacacattgcccgcaacctacacaacgctcgtaatcaatttcggcctttcggttgttattcaaatggatggcatcgtgagcgcagtgctttacacagatgttacagcctttacaagcctccgtatcgatacggggttgtgaggcacaatgtaattccagtttaccgcctatgctggcgcatcccatcccgaggtttttcagcgcaccgccgaaaccggcttgctcgtgacctttgaaatggttcatggaaatgatgatatcggcatcggcgatagcggcacctattttcggggccttgcaatattgcccgtcaatctcgatttcccggtagtccgtacctttcacgccatcggcgatgataacgttgcaaccggcggacatgggattgaacccattttccatggcgctttgaagatgatcgacagcgttggagcggcggcccgagtataaggtgttgcaatcggtaaggaacggtttcgcgcctaattcacgtaacaggctcaccaagcgagcggcgtaattaggacgaatgtatgccaaattccccggttcgccaaagtggatcttaatggctacaaattgatttttgaagtcgatattggcgataccggcacgttttaccagacgttccatcttatccagcaggttgctgctgggggtcgtgcgtaaattagtaaagtagactttggatgtattcatctttttattggtttagtgttgacaaaggtacgaaaaacacggaacattttttatattcgcgtaaaacagatttgtatatggacttgcttcagcggaatcatcagctattgttgaaaggaataaattgtacattcctgcgttatttgcatgcacggatagagtgggaggatcggttaatcggcatcttcggctctcgaggggttggtaagactaccttgttgttacagcatattaagttgaaatttgaagattcacgggaagccctgtatgtgaatctggatgatttctggtttgagacacattcattgaccgatgcggttaaggagttcctgcaagccggggggcattatttgtttttggatgagatccatttctattcgggctggatggaagaggtctcaactttattggatgccaaccccgccttaaagattgttttcgctaccacttctttgtactcgcagacagaggtgcggaacgggttaaggcatgaggctgctttttataccatgcatccgatgtcgttccgtgaattcctttcttacgaaagcattctggataaagatcccattccgttggaggatatcttagcgaaccatcatgatttggtgaaggagatcaatgcggagatgaatattgtgccgatttaccggaactatctggaacatggatgttatcctttttattggcaagacccggatatgtattatttccgtctgcaagaattagtgagaaaagagatttgccgggatttgccttcggtggtttctatttcgatgagtaatctggaacgagctcaaaaatattttatgatggtggctgagtcggctcctttacgtccgaaatcgattgatgtaacccgtaagataaatatgcttcgtcagcaaagcgatagcctgttgcgtttcttccatgatatgaggcttatttattactcggcagaccaactgggaaccactccggccaagcagaaagtctttatgggggataccaacttgctgatctcttttttcggagataaggagaatcggcaattgatgtgtgaaacctatttcttaagccagatgcgttccgtggcgaacgtggaattcatggcgaacggggatttcttgattggcggtaaatatatcttcgccgtaggtgatcccttaaggggatatgatcgtctccgcttcgtacccgacgcttatgcggctatctacgggttaccgaaaagcgtgtttaaccgtatgccggcatggatattaggatttagttattgagaatttaaaaataggattgctatgttagaatgcatgaagaatagaagaagtatccgtaaatatacggatcaggatatcccggagtctttgctgaatgaattattggaagtggctactcgtgcctcgaatacaggaaatatgcaattgtatagtgtcgtggttacccgcgaccctgcgaacaaggagaaactggctccggctcattttaaccagccgatgattacgggggcgcctgtcgtacttactttttgtgcggacgcgaaccgttttgttaaatgggcggagtgcaggaaagcggaggccggattcgacaatttgcaaacgtttatcgcttcgacgatagatgcgatgttgttcgcccagagtttctgtaatgccgctgaggaaaaaggcttaggcatttgctatctgggtacgacggcttataatgcggaccagatcattgaggcgctttctcttccccgtctggttgtcccgatcgttacggttacggtgggttatccggcagagcctatacccgctcaagtagaacgtttaccattggcggctgtggtacaaaacgagacttatacggactttactccggcttccatcgatgccttgtatagagagaaagaggcattagaggtgaataagcagtttgtaagggagaataataaggaaacactggcgcaggtctttacggacgtacgctatacgaagaaaaatagtgaacatttctccgaggtgctcttgaaggtattgaaacaacaaggattcatgaagtaagccctaatacttctaccttatagttcataaagagtccactctcgagtacgcccgtaatcgacttgagagtggattctgtattttcagggatatagtccatccatatgtctaggatcatattgccattctcggtatttttattttatcttccttatgggagatctgattcccccattccaacgtattgattagcgaatgatcccacttcatagtcttgatattattatatacggtctaatacagtttcaatcagtttctccaaagaacctttataatccgtattcatatgattatccacacgtccggcgataatacagcatacggtcattgcccggtgtcccataagggcggccagacctgctaaagaggagctctccatctcgaagttcgtaatctttcgcccgttgtaatcgaaagcctctattttccggttcaattccggatcggtcaagggcaatcggagctcacgtccttgcggcccgtagaagccattggctgcgatagtcgttccccggataatatcattacgggtgatttgctcgatcaacgatggatctgccgatacgacataaggccatatgccgctaagccgccaatcaagctgctttattaattcagactccaagtccgcgtcacgaacggtattactatttgcgtagaaataaatgaccccgtcgaatccgatcgatttctccgctgccacataagtcccgatcgggacaaatggctgtaaccctccggaagtcccgatacgaaccagggaaagttgcttgaattccggcttgatcgtacgggttgagaagtctatattagcgagagcgtctagctcatttaatacgatatcgatattatctgtgccgatgccatgggatacaaccgtgatacgttttcccttgtactggcccgtgatggtatgaaactcccggctggaaacctcacattcctgagaatcaaaataggaagcgacggttgtaacccgtgcgggatcaccaacaagtaccacacgatccgcaagttgctccggttttaaatgcagatggaaaacactgccatctgaatggatcgctaattctgaagcggggattgttctcatattcaatcagataattaagtttatattataatcatgaaagggcaaggtatgaaccctgcccttggagatagttctatttatataactattttagtcctttaatggttttgatggagcaccggtcggtttagctatcgcttcacgcatagaagtgtccgcctcgatgttcttcatcttgtaatagtccattacgcctaggtttcctgtgcggaaagcgtctgccattgccttgggaacttccgcttctgcctcgatcaccttggcacgggcttcttgagctttcgccttcatctcttgctcgagggcgacagccatcgcacgacgttcctcggctttcgcctgagcgatattcttatccgcttgagcttggtccatttgcaagaaagcgccgatgttcttacctatatcgatatcggcgatatcgatggaaaggatttcgaaagctgttccggcgtcaagccctttgcgaagcactaattttgagatggaatccggattttccaatacagtcttatggctttcggatgaaccaatggaagatacgataccttcacctacacgggctaagatcgtctcttctcctgcaccacccactaattgcttgatattcgcacgaacggtgacacgtgccttggcgattaactggattccgtctttcgcaaccgctgttaccggaggggtatcgatcactttcggatttaccgacatttgtacagcctcgaatacgtcacgtccggccaagtcgatagcggtagccatctggaaaggaaggtcgatattcgcttttgaagcggaaaccagcgcatgcactactttctcgacatgtccacccgctaaatagtgcgcttccagctcgtcgcgtgtaagcgtctttattcctgccttatgcgcttcgatcatcgcacgagtgatgatgtagggaggaacttttcggatacgcatcaagaataactggatcaaggagatattgactcctgatactttggccgagatccataacaggaacggcacataatagaaaaagattgccagcagaagtactgcggcccccaataggataagtggcaaaaaggttatttccatatataaaaaattaagcgtgaatatttgtttcttctttaggacggacaattacgttgtaactgtctaccctgatcactacgatcggcgtgttctcatcgattaattcgtcttgagatttcgcttccacgttaatacctttaatccgggccttgccgataggggctaagcgtgagagcgtgatcccctcgtctccgggttctattccgagatccctgctggatgtcagcttggaatcgatatctgtctttaaagcgatcttgttaaaagaccgggaacgcaataaccaagcgaagattattccgaatgtaatgattgataaggataaagtcagatgccctacccatatacctaccgtataagcgaaaacgactccgccgatagcgaaaatagccccgcctatacccgcaagtgttattcccggaagaaggaatatctccgccagtatcagtaggatggccgctaccatgaggaagacgatgatggctatgtccagtagcatagttcttcttatttatggttgtttcttaggtatacgatctctgcgttacgtgcctttttctcccattcgtccggttggccgagcaggttgtttaatttttcttccgcatcaagaatcgtaggcttcagttgttctcgcttcgccttgttccctttgatgtagctggctcgtaagctctctagtttctcatttaactccttgatctgtttatggatggaaactactttctcgtagtagttcttcgcttccggactttggatatcgtccaaggtgtaataaacgatatcattatggatcgggaacgtgaaatctttctttatctctatacgtccgtaaggaatctcggtatgagctaaatgaataagctcttcgtaattcgatccgggtttccatgaatccttgatcgaggcaatagaggcccgggcacgttttagttcgatatcctcgctatctactcgctcgcggttgtcattcggaatgaataggtatacacaaacttttccttccggttgatagcggtcggaaacgaaccatcccaattgcttagcttcgtcgatcaccatcatgtaatcgttaaacggggagttatagggcatgcccaattgctccggtgtaagataagtatcggaattgatgttgtaacgagtgacgaataaatcatatccgcccagagagccgttccctttggatgcgtaataaatcgttacgccatcggatagcacgaatggatacccatcgtcggcgtcactattgatattcattggtaactgtttctcgtctccccattgatccatgagcttggattgggtaaaaagacaattgtggttaccgtctgtcgagtgggcgtaataaatcttatcccccttctggttcatgtataccgacgagttgcccgggtcgttagtctggaagaaatcttggtaagtggtcaacgtaccgctttcctcgcttaaggtataggctgataagaaatcatctttatcaacgaccaagctatcgataatctggacattctctaccttatcaagcatacggcttgctttgttcgccaagtccatacggatctggtaaggttccacatcttgtttcttttttgttaggagggtgatgtattcgtcgaacatctcctcggcttcgttaaaacgataggtctggtagtatacttctccaaggtatcgataagcgtcttgtaccctacgctttacggcgaccttaagatgtttctccgctcctgctaaatctccggtctcgaaacagcaaacaccataccattgattataagaggcattgcttggcgcttgtttcactagtttctcgaacacaggtttggcttctgcgtatttcccgtcgttatataatttttttgcctgatcaagactttgcgcatgtagttgcattcctccgcatatgagtgtaactcctagcgtataaagcagctttttggataaccgtttcattttgtctattctagattatatatagttatgcagtttcaaagataagaatatttttgtagaggcatacaaatcgaaaagataaatatataattttgcgcccgtaaaggaagtatatggcaaaattgacagaggacgaacgtttgtttcgcaagatagaggataagataaagagagcgattttcgactatggcttgatcaatgatggcgaccggatcttggtcgggttgtccggaggaaaagattccttggccttggtggatttactggggcgcaggtcgaaaatctattgtcctcggtttgaggtcgtggtagcacatatcgtgatgacgaatatcccttattgttcggatcgggaatatcttagaagttgcgcagaggagcatgatttgcctttcattgtccatgagacaagtttcgatccttctacggacactcgcaaatccccctgctttttatgctcttggactcgccggaaagctttgtttgagatcgctaaggctcataaatgcaataagatcgctttaggccatcatcaagatgatatccttgagacgctgttgatgaacctgacccaccaaggggctttcgggacaatgcctccccggttgagaatggataagtttgatatggagattatccgtccgatgtgtctggtggaagagagggagttgattcaggtcgccgcatggaaagggtaccggaaacaattgaagaactgtccttatgagtcgggttccagtcgttcggatatgaaagagctgctgagaagtctggaagcgatcaatccggaggctcgttacagtctttgggggagcatgacgaatatacaagaagattatttacctcgaaaaataagataatatgcaaagtgtttatacgattttattgttgatcgtgtctaatatttttatgacatgcgcttggtatggtcatttgaagatgaagcaacagtttagctggttcgagcatcttcctttgtttggcgtaatcctgtttagttggtttctcgctttttttgagtattgtttccaagtaccggcgaatcgcatcggtttccgggataacggggggccgttcaacttgattcaattgaaagtgatccaagaggtgattacgttggtggtattcgtggccttcagtaccatcgcttttaagggggagtcgtttaaatggaaccatgcgcttgctttcgtattcttggtagcggcggtttatctggttttcaagaaataaagtcgttgcgtttggctttgataatcagcggaataccttgatgcctattgtaagatgcttacaatgcctattcaagcatgtttataatgcccattgtaaacaccttataatgggcattgttaaaacgctacatgatctgttggctcagatgtgtaaatatagcttcggtctcatccggatggaaccatgttatttctgggtcccgtttaaaccaagtcatttgcttccgggcgtagacccgggagtttcgtttgattttctccacggcgaggtctaatgtccattctccgctgaagtaattgaataattctttataacctaccgtgttcaaggaattcaaatgacggaagggataagcccggcgagcctcttccaataatccttcgctcatcatttgatctacacgttggttgatgcggtcgcataattcgtcgcgatctctattaagccctactttgatgatccggaacggacgctctttcttaatgttcgtgcggaaggaggagtaaggcttgcctgtcatccggcaaatctctacggcatggatcactcgtttataattatccctgtccacttcctcataatggacagggtctgcttcttttaattcagcgaggataggggctagtccctcggtttcaaattgcatgtatagggcatcccggatctccggtgtaaccgtcgggatatcgtcaatacctttacatacggcatcgatatacatcatagagcctccggtcattacgacggtcgggatcgttttatgtaattcggataggagggagaccacgtcttcctcgaagttgctggcgctgtaataatcggtaagcgagagagtgcctaccatataatgcttgacacgagccatttgttccggtgtaggggcagccgtgccgatcggaaggtctttatagagctgacgagagtcggaagagataatcggagagccgaaacgttccgccacttggaggcttaactcggtctttccgactcctgtcggcccaagtaatataacgagggaattcatcaaaagcgctcgtcgtcgtaaggattatccatcgggccttcgcctaaaccgtcgaagccgcttttgtctaattcgtccatatcgtattcggaatccccgtaaaaatcttctcctacgtccgtactgccgttcttagcctcgaactcatcgaaagaaactatttgggcgggaggcgtacctaccgatttgctgcaaataggagcatccaagtcttttcccggaacgatctcacgaagttccatgaagaaggcacgttcggtcatataatcgaaaacgaaaagtagtttttggtgctcgtcttccaacaattcttccagttgagtatcggccatgacatagctgtcttcctcggaagaggtatccatctccactaatgtgatctctgtctttttactccagtcatcgtcacatatgaagaaagaggtcatttgatcctttgtataacctacagagtcgaggatggcgttttgcaaatccaagaaagtagactcggaatcaatcttgatctcgcgcttgaagtcatctgcttcatctgataggattagaaatctaaatagcatagtcgtttagttttattatcgcctcaaaagtagtaaaaatatggatatacccaatatacgtcgctataaataatgaaagagggtgtgcgtctgatccctgtatgggatttttgacgcacaccctgcttatacatcatcctcgtttgtttatcgtacacttaccttcgtcgcggcatgacggccattggcggacagctcgattaggtagatgcctgccggggcgggtatgcgggtgatatcgctgacattgccgctgtagaggcaattaccggtcaccgcgaagatacggatggaaaccggtgcggtcggttctaccatgacagccccgtggataccatagacacgtatgccctcggcgatctgttcgatgcttaccgtggtggatacgcttacgtcgcaggtggcggtcttgttaccgtcgtcggtagcgaccgtgatcttgcaagaacccaccttcaaggcggtgacgattccgtcggcatcgaccgtggcgactgtctcgtcgctactgctccaagagacggactgcattgtggcgttactcggcgataccgtggctttcaaaacgaaagactcgcctacggcgatgctcttggaggtaacattcagtttcacgcctgttacacgtacgtcgggtacgaccggagtatccggggtggattccttcatcgtggcgatgattgccaaggagccttccacgttatcgatctgtgcggagttgctcgtgtatgacttttcaccgatctgcaaattctccagttcatagcccttagccggttcaacctccacgatcagcttgctgcccggggcaacggcggtgccgctgttgatctcggtctgctcgccgctctcgtctacggtgtagactttcagcgttccgttctcgggttgctcgaaggtgatgacagaggcgccggtgctcttcactgttaccttggcgtttgtctcgttgttcgaatagttcggatcgtaagaggtgaactccaccttgtaggattgatcgtcacctacgcccgggatcttgttaggctctgcccattcgaagataccggctacggtcgtaccgtttgttgaagctgttgaagccacgccaccggaaaggatggacgcgctcaaaggttgtccctcggtcagctcggaagcggtaagggtggtgaatgagttgatcgtagcaggcttgatcaccaatttaatattcacgtcatagaactctttccactcatcgttaccggcgaagcttacattgaccatataagttcctgcgttcatcggagtggcggaagatccgtcaacattcgcatatttcaatacgatctcattctccggaagaccggtctcgttgaacaattcagacaatgagactacttggatcgcaccatcgtaagacttttcaatcaaacggttcttaatggagagtgtctttagggcctcgaataccggagtatatgtagcgtcagcattcatggtaacctcacgctcgatattcgtgtcattgtcttctttccacttaacgaaccgttggccttccggagcgatcgctttcagcgtaagtttcgtaccttttgctatctctgtgcttgttacctctaagccgccgtttgttacataggtatccttagttgtcaacgttacgggctcaacatcacctactgcaatatagtaatctaccggctcatagttgttctcgtctttcggggtgaaacggatcacgttcactttgtcgttgtcaggagtacctgtagctgcagctctaagtttggatagagtgcttacagattttggattccaagctataccagcgatatcttgtgtcaactcagcggtcacatcattgccgtttaacgtaggaacactcttcagtgccatacctgccttattgatcaccaaggtagcggtctcgcttacggccttgtaaagatcatcctccggacgggtgatgtttacggtgtaagtacctgcgtcttgaggcaaagtctcacctaagcttacgccattcttcgagtaagttacctgaaagcccttggcggcgtgtccacctttcaccttcacttcgtagctacgaggttgcttgttgtagaccaaggactgctgggcagtgttgatctccagcttagtcttcccgatatagttcgccgcaatcgtcatcgggccggataccaccaaggtatcgccgtccttgatctcggaggagttcgcggtcatgctcttgaagcggtagccgctgttggtcgtaaccgtggcgactagtctcgtctgatagtttacatctgaaccggaggtgaccgtagcgttgtcttcaaccttcgtcaaagagacggaacctgcggtcgggatattagcggcggctgtcaccttgaattgagtcaacccaaagtttaccttaacattggcatcggctgtacctaccgtaaatgtattgtccgtagagctatcggctgcgttttctacgtttacgctgttcaaggcatatccataatcggccttgcagattactttcactatcactccttcagcgatagccgcacccggtgtgatcggggctttgctcttattatccagcaaggtcacgctaccatgtcccgaattgcttacgttcaccaagtgggtagctgccggtttctcctcgaaggaggcctctatcgtggcggcttgggccaaggtataggaaccggtgttcaccaaggctccgttcaccttcacggacttaaccatcatatgcttcttgtcagttggcgtggcgttgatggtcaataaagtgccttgcaagagtgcctcgccatccttcacctctacaccgttggcgtaaacctcgagcgtgccgttagccggggtaccaatatttaccttgtgtaagatagagtcgaagcgggctaccaattccagatccttcgtcgcggttaatgtacgaatggcggatgtgtttccatcgctccagccggcgaacgtatagttcttgtcggcgatcgcctcggctgctagctcataaccctcggcgtagcgatcgtttgcggaacgtccggtcaacttgaccgtaccgaagttggcggcggtaaccttcatcgtataaacaggggtaacctttacattaataaatgtatcttttgcgagataaagtatcggatcatccggcatgaacgtgatactgtattttgtcttcgtcaaggaaaccgtgtcgttcgggttcgtccacacgaacgatccagtggtaccctcgacggagccaccttgtaatacggctatagacaacggctcgccctcctcgatatatccggcgtcgggtaacttcgagatacttacctctttcttgctctccactaccaatgttgccgtatcggagaggctgcgatatgtcaaatcctccggacgggtaaaacgggccttgtaggaaccggctttcagtgtggaaggcaattccttgatccaattcgtaccattcacttgatattcgatctcgatatccttgatatcgctcgctaccgttacttgcttgatagagccttccatctgggtcaggttgttggccacgaacttcacggtgtctttcgagatgaacacgaaggtgtagccggctcccgccgtaagttcggaggtagtgtacgtgtaagaggtcttaccgtcggcatacgtccccgctatcttggagatatccacatccgaagagccttgcttgatagcccccagcttataatttgagttcgacacgatcgagaagacggcggctttgccataagcgatatcgccaccactaaccacgtctttaccatccatcttggcagtaaccgtaccatgttctcccaccgcataaaccaaggcgttggcaccggttaccgtgaaggtattcgaggaatccgtcaaggcggcgtattccatcgtctccggactgatcaagacaatcttataaacgcctacttcggcgggtaaatcctttgtctccttactattgacggcacgatacgtcacggcttgtccgttcatttccggggtaaacttgattacgggcagattctgtttcgctaccacttggtccttggtagccgaggaacctgtcaccttagcggtcaccttcatcttctccgtgaacacgacatttatcgtggctgaagcggtcagttctccggtcgtgtaggtataggagatcgtattatccgtgctattgaacttacctgtaggcaagttagcgggcttcccatcgatctttatctcgctcaacttgtagccgggcttggcggtaatcgtcaatacggcggttttgccattcacgatatcaccgccgttagccacgtccttgtcgcccatcttggcggtaaccgtaccttgttccccctctacgctccagcttaatttgttcgcttgagagatcgtgaacttgttgctctcgtcggtcaacgccgcatagtccgcggtctccggactggtagcgacgatcgtatatacgccgtcagtggcagggagcttatccataagagttccggaagcattcttgaactgatacttctggccggaaatactcggggtgaaagtaacagttggcaaattcttatcggcagcgatctcatccctcgtggcggatagcggactggccgatacggaaacggtcttctttgcggtgaactccacgttgatagacatggcagttttcaagttggcagtcgtataagccgcataggtagtgaccttggtagtagcatcgaaagtaccctccggtaaatttaccacttgattatctacggtaagcttgcccagcacatagccggacttggcagtgatcttcaacacggccggcttgtcgtaagcgatctcgcctccgctagtcaccgccgtcccgttcatggtagccgcgacggttccttgcgtcgcttcgaaagtataagtcagcgtatgggccggcagtatctcataatcgaatttcttgtcgatggcggcttgcgtggccgtctctgccttggttatgagcacgttgtactttcctaccgtgacgggtaagtccgttgtctctgttccggtagccacgttcttatacttcactgtatatccggttacatcctcgggagtaaatgccagcttcggcaagttcaccttcgctttcacctcatccagcgtagcggaagcgggagacatcgtgaccgtcacagggtcttttgccttgaatgtcgcctttatctccgtggcttttgccaaggcgggagatgtataggtgtaagtagtcgtattatccccattaaatgtgccagtcggtaacgtgccgatagtggccgtattcatggttatatccgcaagcacatacccggcattcgccgtgatcgtaaacttgggggcggtgttgtatgccacctttgcgccactcgagatgtcgctggttatcgttccgccctcacttgcgctgtagttgagcgtcaccttgaacgtcggtagatccggtgccgagcgtaaatctgaatcctgtgcgtgtacctgtattaacgccataagtgcgaggaacacggctgatattagttttctcatgttattctgtttttaatcgttacttaactcttactaattgaccgtttacggcatagataccggcgggaaccatgacgcgttgcccgtccgtggctattcccttgtaggcgatacgaccgctcatctccacgatcagtacctgtacaggttcggcggtatggatcatgatagcgccacgatcggtagtcacgtaataaccttccaccggctcaatttcctgcgtgcccgttacgatattgtcgccgaggcgcaaggaacgaagggtgctatacgttgaggcatccgtaaagatcacgctctcgaacggttttaaggttttttccgtacattgaacgaactcattgcttgcggcattcagcttatatacgtattggttcttcgtaagtgtcaactcatccgtacccgtattggcgaagatcgtgaaggtagccgtagtcggggcgtccggctcggtagcggctttcagctcgataggatctgcggcggtggacacgatcgcatactcaccagtcgttgcggagagtaaaccggcctgtccgaattcgtctgtcttgtactcaaactccggagaggaagtgcccttcaaggtagcgtaccatgcgccggtattggctttcggatccgccgtaggttgggtgtattctgttgccggttctgtcgtgctctgtactttataagtacttgggaaaccaaatgctttccactcgctgtccttcaagggtgtgttcagttgaagggtagtagctgttatcttgtctgtcgtagtcgcgggcgaagtcggaaccaagcgtgcgccttcttccatcgtcaccttagccaaggcaagcggggcggtcacgttcagcgtacccgtattctcgatgtagacattccgattggcataggtaacatcggctgttagggtttggccggcggtcacgatcagacgtttcagccacatagcgacgcctttagattcagcggacatttgtaccaaccgttcccatgaatcatccggtacgaccacgatcttctcttggtcataaagctcggaatagatcggggctttctcggcgaaagtagagttcgcgtcaaaagtgaagcaaagcgtagaatactcgggcgtacctttatcgatattgacaccgccccaagcattaccgctcgtgtgcatatcggtagcgtccaccttggagtgaaccactaagcctgcagccgtattatctttcaacgtaacgaaatccagcttgacagccatggacgtttgtacgttcaaaccgttccgtttcgcgttgctcgcggtcaggttggagatcactacctcgcccccttctgccggggtgatacctgtagcgttctcgatggcgatcatgttcagatccgcattatacgtatgcgcccaatcagcggtacccgccttaatgaccgtcttgtccattcccgcgccgttcaataccatcggtttcgtgattgtcaactgggatggtaactcataggtaccctccaccaacgcgatctcatcggcatggacactggctaaggctaataagtcgctagcgtcgagagcggtagcgtttagggtgccttgttttgtgaaggtcacgccctcggctatggaaaggcctccatccagattccaagtcttaccctcacctaaagcgaactccgataaggtaccgggaacggctgttccatcccggaagcttaccaacgaggctttggcaccactcaaattgatattcgcttgatgcaagccacggctgaacaccatcagaggagtagcgctcttcgaattgatgaattcaaaagagaccgtcccgtctacggcaggtgccggtcgtccattcgtatcggaatcggcccaacccatgatcgctcccaaggaagcgttcatgttttccggctcttggaacgtacaaccatcgaatttaaaagaggctgttcctaccgcacctctgttgatagtggcgaattcacgatctttgattgccgtaccattaatcgaagtcgggaacgtacagcctgtgaccgtagccgtaatctcatccgcacgaccattcgataacgtgccatagaaggcggcgatagtggcgttctgtatcgtgactgtcgagacaccggtatgcgtatatccgtttcctccaccacaaccgataccctcggctatcacgccaccattcatattgatcgtgactgttttaacaccatttacggattgatcgagcggagtgtcgatcgtgtttgtagtcttaccgccatcatcacctccgggataaagctgactcaccgttcccccttgaatctcgatatatacctcattcgctttcgagtaacgatatccaccgcctaccaacaaataagaaacggtggcatctttctggatttgaatagagatcttgccggtaacatcagcgggagtatctgactttgtagaatttccaccgcctaacattgttctcaccgttccactgatcatattaatagatgtggaagcaaccgtagactctttagctccaccatatatcttagaggtagaaggaaccttaaacgctactgcggttttcccttgtttcgtgattttaacagaatcggttgaataagcggtaatctcgataggcgttccattcgcgtatacgtcataagaggtacctttcggctgtcttaccgctgttatcgccgagacaagcgtaccgttattcgtgaaagtcacggcagtatcaatcactaagccgtcattgaaagtccacgtcttgtcagcagacaaagtgaactcagacagtccttccggtattttctttccatccacgaaatgtctcaaggaggctttcgctccggtcagctctatattcgcgttatccaagccacgccccacggagaaagtcggcgtctcggtctttgaattaatgaacttgtaagacacattcccgtttacgattggctgtggctttccattggtatccgaatcggcccaaccgtcaaccgcacccaaaccggctacaatactctccggttcctcgaacgagcagccatcaaaagtgaaagagatgttcttcactcctccgcggttgatcgaagccaactcacggtactggatatccgagccattgtattgtttcttaaatgtggtatttgtcatgttaaccgttatatcatcggcataaccattagataaggttccgtagatcgcacctaactcggaatcggtaaccgtaacaacagacgtacccgtatgtgtatatccctgtccaccgccggtaccaagaccttccggtatggtacatttcgagagggtcatatttacgttttttacgccattgacggatgcgtcaacatcggtggtcagcgtattagttgtctgcccttgatcatagcctccagcatagattgccatgatcgtggcttgatcagccttgatattcacggtattggtctttgcgtaataacgaccaccacccaacaataggttgctgacaaccgcacccggctttatttcaatactgacagcatcgcttacatccgcgctcacgggagtgtaatacgatccgtcactatttttatagctatatttatccgtgacagcttgggtcgttttgcctgtacccgcattgccgacaaacatgccaccaccaaatatagaccggatactaccgctttccaacgtgatcgaagcagaagtcacggctttacctaggctaccgccaaagacaccgaacttgccgggctcaaactgcaaggtatccggagtcccgccatcggtctctattgtttccacgatcatacgaccgctggcttgattcaaataaacacgaaccggattaccgtttgcgaagcaagaaggaatgctttctagagccgggtttgaaggtgtctgcggcaaaatcattttgcagagcttaccaccggatgaatacaccaatgtgtccacatcctgtccccagccactgcttgtcgccgtcaaagcgagcgcaagcaaatagagtaatttgtgtctcataagcttatgaatttaagtgttaataatgtattaaaatgaatggtataggacctttccgacaccacccgctgatgtctcgagatatcacccgctgatgtccacagagagcaccggctgatgtccggagagatcacccggtggtgttggaagggatcaccgggtgatgccggagggccgccctttagatctcatccggactctccgagtcgccgccttcgctactagagtcgttgacgggcttgatccgttcgtaggtcactttcgcccgcatgtcttgtaggatcttgccgggagtatagaccagactcggcttcttcatcatgaccgaggcggcgaattccttttccgttacgctacccttactgccgaccgcaagacgcatgctgccgaactcgcccagctggacgttgcggccctctttcaggtgacgggccaagatacgcggcaaacggtcgaaacagcttttcacgtcggcactcgtcaaggcggtctcctcggctatgctctcgcagagttcgtcgaagctgacgtttccgttggatagcatttgtgcgaaatatttcttcgcgtctttagcagcccctttggagaagtcgggacgttgaactaatttgtattttacactcataagtatttatgtattggtgaacttgttttcacaattagtactagcaagtaattatccccttgacctaacgacctttactctgtggcgatcaatctctcttccctatatccctcatcattggttggtgctccgcagcgtaatagttatggttatcaaataaaaacgactagtttaaaccaacgtttggatcttgcgtttttaggacttggaacgcaccatatatctccttgcgttaaatagttggtttataagaaaaataatcaaagaaagtgtaccgctatttgaaaataaagccttaaatttacgacgaatttaaacgttggtttagaatagccgtttttagcatatgatataatgtatgtatgtacattagtaagtattaaaatagtggacaataggtaattgtaatatgggtaaataataaaaatcacagtatcagatatcaatcttttgcatttcgtccgaaatgacatatctttacgacaccgcccgctattgggccgtaacttaaaacctatcaactatggataaaaaaaggaggatcaacgcatgaaagaattaaaagaccgatacatacgtttcgattgggcgatcaagagactgctccggcaaaaagccaacttcggtgtgctggagggttttctcacggtttttcttggagagaagattaccatcgtggagctactggagagcgagggtaatcaactgtatgaggatgacaagttcaacagggtgtacgccgaggcacttaacgacaagggcgagatcatcatcgtgaaaatataaaatattcgcaagctatattatctcgaacaggtactctatggcgtggcgaaaaccataaccgagtacatatcactgggcgaggactaccacaaggttaagaaaatatactcaatcaacatattctacttcgacatcggacggggcgaggactacctttatcacgggcagaatcatttcatcggcatacataccaaggatcaattggtagtcaacacgaaagagaggagcgtaattgtctccaagctatcccccgagattttccccgaatatatactcatacggaccaataagttcgataagatagccgtcactcccctagaagaatggatggactaccttaaaagaggaacaattcgtcctgacaccatgactccgggattaggcgaggctcgagaaaaattgagatactactccatgacccccgaggatagatacgcttacgacgaacacctgaatgcggtcatgatacaaaatgacgtattggattcggcgaagcttgaaggatacctggaaggactagcggaaagtagagcggaaaataaggagaaaggtaaggcgaaaggactggcaaaaggcgagacagaagcgaacctcgaaaacgccaagaagatgaaagccatggggatcgatcttgaaatgatccggcagatcacgggaattaccctataaataaccttttggtgacataaatagcgaatcggcgcaaacccctcatcgtaagatgtggatttgcgccgatttgtttttggttgtccggatgtttgtgtcgcttattcgtcgatcgaacctcttacgataccccggctggaagacttgatgaaattgaggatcaaatcccgttcctcgctaggctcgtactcggtctcgatcgctttcagcgcctccgtattattcaagcctcgggtatacagcgtgcgatagatgtcttgaatcaagaatacctgctgattcgtgaatccccggcgacgtaaacctacgatattgataccgcaataaacgatcggatcacggccgatcaaggtataaggagggatatcttttccgatacgagaaccgccttgtaccatcacgtgcttggatatacgcgtgaactgatgcaccaaggaacctccgcttacgatagcgaaatcatcaatctctacctccccggcgatttgcgaagcgttaccgatgataatatggtcttttaagacgcaatcatgggccacgtgcgaataagccatgattaagcaattgcgacctaccacggtcttacctttggaagcggtaccccggttgatcgtcacgcattcgcgaagcgtcgtgttatctccgatttccgccgtcgtggtttcccccgcgaatttcatgtcttgagggataccggcaacgaccgctcccgggaaaatattgcaatttttaccaatccgtgcgccatccaagataacggcgtgagaatatatatggcaattatcaccgattacgacatctttctcaatcacggcaaacggatcgatagttacattctggccgatttgggcctctggatgaacgactgctagaggagatatattcattatcgtactttatcttattatttgttttttacaatctgagccatgaactcggcttcactaaccaatttatcaccaacgaatacataccctttcatggtagagatcccgcgacggatcggtgccaataattccagacgtaagatcaacgtatcgcccggaacgactttttggcggaatttcacgccatctattttcatgaagtaggtagaataacgctctggctcatctacggaattcaagactagcaaaccacctgtttgtgccatagcctcaacctgtagaactcccggcatgaccggctcctgagggaaatgcccttggaagaacggttcgttggtcgtgatgttctttacgcctacgatatagttcccgccaacctcgatgatcttgtcaaccaataagaacggatagcggtgcggcaataattcacggatacggttgatatccatcaccggctcacggttcggatcgtataccggggcttgcacctcgttcatcttgatatccttgcggatcatacgagctaactggttattgatcttatgtcccggacgggtagcgatcacacgtccgcggatcggcttaccgatcaaggcgatatctccgatcacgtcgatcaatttatgacgtgccggttcgttatcgaatacaagcggcttgttattgatatagcctaattcctgcacgttcttgtgagggatgttcagcatatctgccaatttgtccaaagattcttgcggtatcttttggtcgtagataacgatcgcgttgtctaaatcgccacccttgatcaagttattgttgagcaacatctccacttcgcgtacgaatacgaacgtacgtgaagccgccaattctgtcgggaattcgctgagatcgttcaacgtggcgaattggttggaaagcacgggcgaatcgaatgagatcaatacgttcacgctgaacttatcatccggaaggatgatcaacgaagaaccggtttcctcatcttttacctcgatcttgtgctttacgatataataatccttcggagcgttttgctcaacaacccctgtcttttggatttcctcggagaagaagcgagaacttccgtctaggatcggaaactcgggtgcgtttacctcgatcaagcagttatcgatctcataagcgtataaagccgccatcgcgtgctcgatcgtacttacttgaacgccattcttgctaagcaccgtaccccgttgtgtattaaccacgttctcggccaaggcgtcaatcgtcggttggccttccatatcgacacgtttgatcttgtatccatggttctcgggtgcgggattaaacgtaatctctatatctaatccggtatgcaacccttttcctttcaaggagaaacttgccgcaagcgttttctgtttttgcataggtctttattgtttattaatttctttcttgagttgttcgatctcccgttgcatttgccccagcgagcggtatatatccggaagacggttgaagatcgcgctggaacgcatgaagttcttagcgttgatcgccggcgccccgagcaatgtcgtcgcttccttcacgtcgctgataacgccagcctgagctccgaatacgacgtggtccgccacatggatatgtccggccaaaccaacttgtccgccaaacatacaatgctttcctacttttacggaaccggcgatgccgacttgcgccgccatcacggtattctcgcctacctccacgttatgagcgatttgtacgagattgtccagcttaacgcctcggtgaatgatcgtagaatccatcaccgcacgatcaattgtcgtattggctccgatctctacatcatcctcgataataacgttgcctaattgcgggattttcttgtaagtctcaccttcgggagcgaatccgaaaccgtcagccccgactacgctaccggcatgaaggatacaattattgccgattatacaattctcgtaaacggtggcatgcggatagaatacgcagttatctcctaccgtcacgtgatcaccgatataagcgtgcgggtataccatacagttcttacccatttttacgccttctccgatgtaggcgaagttaccgacataacaatcgtcgctcacggtcgcggaagcggcgataaaagcggtagaatcaacccccttctttttgctcttcgattgctctaccaaatttaataacatcgcgagcgccgcataagcgttctctacttttacaagtgtggctcttatcggttgttccggtttgaaatcattattcaccaaaacaatgcttgcctcggtattataaatatgatgcgcatatttaagattcgccaaaaaggtcaatgtacctggctttccttcttctattttagagaagttgctgactttaacgttcggatctccttcaatcgttccgttcaggaagccggcaatttgttgggctgaaaactccattacttattcaattatatatgtatcttcgttgactgtccgctgtttatagacagttagtttgcaaaaatggtgaaaattctttatatagcctatgctttgcagggaataattcccttatcatgtagataaccggccatttctttctgtacggcatgtgccgcctcacgggctacgttggcgaaagcctccgtcttatccgcgtaaataatcgcacgggaagaatttaccaaaagaccgcattggtcgttcatcccgtattgagctacttccgccaagcttccaccttgagcgcctacgcccggaactaacaagaaatgattcggggcctgtttacggatatcaaggaacatcttgccttgggtagcgcccactacatacatcatttgctcatcgttagcccattcttgcgatttctttagtactttctcgaaaagacgttcaccatttgcgtcttccgtcatttgaaaatcatgtgagcctttattggaggtcaaggccaataagattacccaagcctccgggtagatcaagaatggttttacgctatcctcgcccatatagggagcgaccgttacggcatctaccttgatatgatcgaagaaagaacgggcatacatctcggaggtatttccgatatcaccacgtttcgcgtcggcgatgataaattgatcgggataattctcccgtaagtaagccacagtcttctcaaaagccatcataccctttgtgccgaggctctcgtaaaaagccagattcggcttgtaagcgacacaataatcggcggtagcgtcgatgatcgctttattgaacgcgaaaataggatcttcttccgacaatagatgttgcgggatcttttttatatctgtatctaatccgacacaaaggaaggattgtttctttttaatattctcgaatagctgttgtttgttcattttcttattcagtatgaaatgattggatgtgtttacaattcagactctttcagtcgctcagcgttctccgctacgatcaggtgatccaagcaatcttgaatttcaccgtccataaaggctgaaagattatagatcgtgtaattgatacggtgatccgtgatacgcccttgcgggtaattgtacgtacggatcttcgcggagcggtcaccggtagataccatggtcttacgcttgctggcgatatcgtccaagtatttctggtgttccttgtcataaatgaacgaacgaagacgggtaagcgccctttctttgttcttcggttggtctcgtgtctccgtacattcgattaagatttcctcactcacacctgtaatggggttcttccagacataacgcagacggacacctgattccaccttgtttacgttctgaccaccggccccaccggagcggaaggtatcccatttaatctccccttcattaatctcaacatcaaattcatccgcctcaggcaatacggcaactgtagcggcggaggtatgtacacgtccttgcgtctccgtagccggtacacgctgtacacggtgtacaccggactcatacttcaacgttccgtatactttctcgcccgataccgtgaagatgatttccttaaaaccgccggacgagccttcgctaaagctagacacgcttattttccatcccttcagttcgcaatacttcacgtacatacgatatagatcaccggcgaaaagggcggcttcgtcacctcccgttcctcctcgtatctcaacgatcgcgttcttgtcgtcttgcggatcagcgggaacgagcaataattttatctcttcttccaaagcgggaatacgttcgttgcaggtatccagctcctcacgggccatttcccgcatttccggatcttgctcggactcaagcaaggctttcgcttcctcgatcccgttcaatactttcacgtattccgaacgagctcccacaattttctccaaatcacggtactctttgttcagttttacgaaccgtttcatgtcggcgatcaccgccgggtcggtaataagggtaccgacttcctcgaaacggctcactaatccgtctaatttaccaagtaaactattttcggccatttatctttattaataggtgaagcgacctttctcgctttcgataatcaattcatttttatcagcttcctctacgaagcccacgatttgcgcatcaataccaaagctttttgagatgccgattacttcttccgcatgctcgggagcgatgtatatctccatccggtgtcccatattgaataccttgtacatctcgctccagtccgtaccgctctgctcctgaatcgtgcggaataacggtgggatagggaagagattgtccttagttacacgcttgttctctacgaaatgcatgacttttgtctgggcccctcccgaacaatgtaccataccatggatttgagagcgtagtttatcaagcaataccttaattaccggcgcataggtacgtgtaggcgaaagcaccatctttccggcatcgatccctaattcctcgatcttatccgtaagtttcaatcctccggagtaaaccaattcttcgggaacggcggcatcgtagctttccggatattttttcgctaaatacttagagaaaacatcatggcgggcagaggtcaagccgttgctacccatacctccattgtattctttctcgtaagtggcttgtccggaagatgccagacctacgatcacgtctcctccttggatattcttattatcgattacgtccgaacgtttcatgcggcaagtgaccgtactatctacgatgatggtacgaactaagtcgccaacgtctgcggtctcgccacctgtcgcgtagcaaccaacgcccatctcacgtaactctgccagcaactcatctgttccattgatgatcgccgagatcacctcgcccggaaccaacagcttgttacgtccaattgtagaagagaccaagatattgtctacggcacctacgcagagcaggtcgtcgatattcatgataagagcgtcttgggcgatacctttccacaccgaaagatctccggtctctttccagtacatatacgccaaggacgatttggtaccggcgccatccgcgtgcataatattacaatattcaggatcaccgcctaagatatcggggatgatcttacagaacgctttcggaaaaattcccttatcgatgttctttatcgcattgtgaacatcttcttttgaagcggaaacgcctcgcaggttataacgttgatcactcattgtactatattatttgaaccgcaaaggtaatacttttttatgttacttatctaagttttaagacatctccttcctccgggatgtaatctttgtcttttttattcattttatacagactcttgatctggattccgtacatctgcgcaatactgtgcatagactctccgacttgtaccacatggtcgtaattcggcttgtccgctttcttctttttcttttccagatatacgatatcgcctgcctgcaacgggaagtcctcaggcacctcgttgaatttcatcaactgcttggccttgaatcccatgcttcgggcgatctggtcgaaactgtcgttatccttagcgtatacatagatcaaaccgtgggtacgatagacttgataattgaacaccggaagattttgcttcttggtagaggtcttcttttttctcttaccggagtcaaagcggtataactcataatcttcgataaccttgattaatttattcgcgtaagcacgatcggtggcgtaaccgcatttttgtagtcctttggcccagcctttgtaatccttgatgtttaatttgaacaggcgttcgtagcgggagcgttcggcgaggaagcgggaatggtcatcataagaatcctctactcgtttgtatttccggaagcactctccccgcaggtcgtcgtcgtgatagaccctgccgcctcgccagtccgaatggcatttgataccgaagtgattgttggagcgtctggccaagtcgctttgcccagctccggattccagtaatccttgcgctaaggtgatacttgccggaatgcgatatttcttttggtgttgaatcgccaaatcactgtatttactgatgtatttttgataggaagtcagcttccgctggctttccgcccctgcgcttaaacagacgagggacaataataatatacctaaaaaatgaagggataaacgcataactgttcttttcgatccgattttaccggacaaatatataaaagaaaatacatatctaccgggaattgatgggttaaaaataggagatacgggctagataatcgtaatgctccccattttctattttttccgctttaaagccggcttgccttgcgtatagattcagcgtgttgaaatctatatataaccaatcaaatgaatcccctttgatacttttatattgcatgcggaaatcgatctctccgaaataatcatcctcgggggcgatatccagattcccgtcttcatcttcaaataaataacttaagtcgctagagtcaagtaaaagctgtccgtcccgggctagaacctcttttaagcggtgaaagaaagccgggagattttccagtttaccgataatcccggaaccgttcattaagagaagaatggtatcgaatggtccggttaagctcctgtcaaaaaaattctgtaagcgggcgtcttttacgccccgtttgttcatggcctctacggaaagaggggatatgtcgatagcggtaacctctttacccatttcctgtaaagccaaggtgtggcatccacttccggcaccaacatccaatattttgcctgtactgagttgaagggctttctgttccaaggagggcatttcttggaaagtccggaataattgattcacgggaatctcatcttcatcgaacatggaggagaatacacggagtttactcgcttttccatgtgcgagataatcgatgatagcggcgcccatcgggtctttatcggatgtaagaagcattgaatgcatatgtctttattctatatataaggtatattctatgatgtgggtgcgaaattaatatattctttttatatttatagcctataagaattatagttatgtttctttcaaaacattaaaacaatcaagaaaatgaaagaattgaaattagagacccgggtagaggtctatgcggtaggagaattggacaatatatataggcaattgtacgaggccgcttttgaagcctcgaaaaaagcttatgctccttattccaagtttcatgtgggagcggcggttctattggagaatggggagatactttccggaaataatcaggaaaacgcagcctatccgtctgggctttgtgcggagcggaccaccttattttatgcgggagcacgttatccggatgcggcagttcagattttggcgattgcggctatgaaggatggggaacgtgtggatcttatcacgccttgtggtgcctgccggcaagtgatgttggaaaccgagcaacgttataacaaacctatgaaagtccttctttgtggaaaagaggaagcgtatctcgttccgagcgcaacggccttgttgccgttttgtttcagtaagtctgatttgatctgatagaataaaaagaggcaagaacgattctcgcccttgcctctatatgtaataattaagttcgattagatccctaaagaagccttgatctgattgatcttttcttctgccgctttctctgcctccggcaattcatcgatactctttaccttggagtgaacctcgcaatagaatttgatcttcggttctgttccggaaggacggatagatacttttgtattatcttccgtgaagtattgaagcacattagaggtagtaggcatatctaatgtaacggtttcgttctctgcatagtccttacctttcaatgtagagtaatcgtagaaataagttaccttagagcctgcgatctctgtcaacgggttctcacggaactttttcatcatagcctcgatctcctccgctccactcttgcctttcttcacgacagagatacctttctccttagagaagccgtattccacgtaaatcttctgaagcaattgatacaaactcaaaccttgatcttttgcccaagctgcgatctcggctaagataacgcaagcggaaacagcgtctttatcgcgaacgaagtcctcgcaaaggaatccgtagctttcctcgccaccaccgatatagtttttcttgccttcgttctcacgcataacgttagcgatccatttgaagcctgtataaacatcgtacatttctacgccattacgctcggcgatcgtcttgatcgtctctgtcgtaacgattgtctttacgatatattctttaccattgatcttacctaactctttccagcgagtgattaaatagtaaacgaacatcaaagcggtttggttaccattcaaaagtacccattcgccttcgttattcttaacggcggcacctacacggtctgcgtccggatcggaagccattaccaattcagcgtcagtctcttttgctttctctacagccatagctaaagcagccggctcttccgggttcggagagataaccgtcgggaaatcaccgctaacaacatcttgttccggtacatggataatgttcgtgaatccgtaagctttcaaagcggcaggaaccaatttaacacctgttccgtgaattggagtatacacgatcttcatatccttatggcgggaaatagcctccggagacaaagaaatcgttgttaattccttgatatattcatcatcgatcgcttgtccgatgatctcgatcaattctttatttcctttgaatttaatctcgctagcgttacggatcttgttaacctcggcgatcgtattcttatcgtgcggggcgatcatttgtgcgccatcatcccaataagccttgtatccgttgtattctttcggattgtgagaagccgtcaagatgataccgctctggcatcccagtttacggatagcgaatgacatttccggagtcggacgtaggtcttcgaataaataaaccttgatgccgttagcggagaagatatcggctgatatttccgcgaacttacggctgttgttacggcaatcgtggccgatgacaacctttatctgttctaaatccgcaaattcctttttcagatagttggataaaccttgggtagctgcgccaactgtatatatattcatacgatttgaacctacccccatgattccgcgcaatccacctgttccgaattctaggtctttataaaaacactcgattaactcagtaggatcttcgttgtcaagtaacgcttgaacttgagcacgagtttccgcatcataacttttcgtaagccatccttgtgccttacttcttaccatttctaataagtcgttgttttccatgtttataatattattgtgtttattgttgagcaatctactcaatacgataaatatacaagaaacaaatatacgaatttcttaaagtaaagcaatcaaaggacttatattttgcctaaaaaatacgataaatcgtcctaccaagtaaacggatgtgtataaatcgactcatttccgcaagcatccgttacgattaatttaagttcatgcttgcctctttgcaacctctctttatcgaagcgataggtaataaccgatttattattcatctcgaataagacaaactgcccgtctatttctccccggtaggtttgtaccccgcttaagttatcggacaaacggaatatgaagttctgtttgctgacccacgtctgttggttgatcggcgtgataaccggagcctttgtatcttgttgtatcttataactgcccaattccttgatatttgcgtcgatccagccattacggtatgtaccgcccatccaagaggcacgtccgttttgtaagcgaaccacaccatattgttgtttattctcaagcgtatcgctttgcaagaatagtgataactgggccgttccatgcaaaggaattggcttatcgtgcaatatgtgggtggctgataatgaggtactatcttctttcaccgaatagcggaagtagaggtcattatatagattacctttaggcatgacgagacggatgcctttagcgccgaacctattctcgctaccccaatggaataattctgtatgagtcgtatcgatctgggggatctcttgtttctttccctcgatccagatggataaacgggtggcattgccgaaagcgtcagcaagtgtatacgtcaaatgataggtacgaggttcatctatacgcaagattccccggtttacgctttcaaggaagcgtagacggtttcccggctcgatgaaactacgcatatagaaagagcgatgatctttccattcttcgtaatctgtgaatgtgttcagataacgggtctcgtcaaatgcgaacttatcaagattactatggaaaatcacttggctgtctgccgtgagcgtgatttctcgtacgccataaatgttagtcgtattatccatataatcataggcttttacagcgagccctatttctccccatgcctcgatttttccagtgattgtctgtttcccgtttttcgccgtgacgggttttatctcaagcttcttgcttttgccgtttactacgccttttccttcgatggggacgatctgtattccttggattttaggaggacgggtatcggttatccgatccgagaaataatccaaggggtccatgacttcctcggtctcggtgtctcgtacctcaaaatggagatgaggtccaccagagcttccggtattgccgcttaacgctacgacttcatttttctcgacaggaagcaaatccggcgtaaggaagagatttacattgaaactttcttgtgcgtattgttgctcttttacataattcgctattttcttcgagaatttttgtagatggccgtatacggtggtcgttccatccgggtgtgtgatgtaaagcccgttaccgtagccccatggacttacggatatacgtgatacgtatccttcttgtaccgtatgtacgggtttaccttctaccccttgtgtcttgaagtctattccggaatggaaatgattgcttcttaactcaccgaagttcccgctcagtaagatcgggaaatcgaaaggattcctaagttgctgggcgtttgtgttgattatgtgggagccgatgattgcgaatagaccggctagatatatggatctaatattcataggtattacgtattttgacagacaaagataatcgttttcgatgaattatctatctcttatcctttggtatcggacttgtacctgatttcatggggcgagcctttcttttttccaatggccgtccggttgaagggtatatactatgcgatcatgaagccggttgggcctaccttgccagaactcgatacgttcgggaatgacggcatacccgccccagtgagccggacgctccacttcttttccaatccaacgagctgcctctctaatgaaagctcgtataagttgcatacggctgccgatgggttgactttgtggggatatacgagctccgatccggcttttatacgggcgttttttgaaatattgatccgattcatccggggggactttttcagccgtaccttcgatatgtacctgcctttctaattgatgccatacaaacgaaagagagattgccgggttttgtgccagttgcctgccttttcggctttcgtagttggagtagaaaataaacttatcatcatgcaggtcctttaataagacggtacgggtggaaggtttgccttctggagatacggtccctactagcatggccgtgggttcatctactttgctgtctatagcctcttgtaaccattgactgaaaagcaagaatgggttatccggaagttcgctttcccttaatcctccttttgtgtattcttgccggattgaggcgagatttatttccatatgtgttctgtttgcttgttgactacatagcttttcttctttaataggataacaagagatcggaaaaaaggtttcaaggttttcttttcagcgtttgatctgagaacgtattagaaaatcgactgttaatggtaaatggtcactaaaaccgccctcatatttaaagccgtaataggttcgaaaaggacgtaccccccgccatgttttatccttagtcaataaaaaatcaggagcgaatatgtggatgctttccggaatgatatgcatggaagactcttgcgtgatgagatcccggtttacgattatttgatcgagttggctccattcgccttggtatttatgactacccgggaattgagttatatgggggcttgcgaacaaattataataggtacaagatgtggaatctgtgatctgcgtattttcaggaaaggcttgggcagcgaatatctcggaaatacttctgtcttgaggggtatcattgaagtctcccataatgagtatctgcggcttttctcgtatcagtaacagggaatcgctagatccccgtaaagtgcgggccgcgtcaaaacgatccttttcactttctttttctcctccgtagcgggaggggaaatgacacacgaaaacatctaaggtatcgcctgttatgatctttccatatacgtgtaggatatctcgggttaatttgtgtttgttcccggaaaaacgaattggaatggattcatgtcgtaaataaaagaattgatctcgttgataaagaagagcgacattaatacctctgggatcggggctttgagtgataatatatcggtaatcctgccagcggagcggtgtgcgacgggtaagatgagacaggacggagtcattctcgacttcgcaaagagctattaaggccggtgtgctccattccccggcagcgcttattactttcgctatttgttgtagcttatgatagtagcggctttgtgtccagtaccggttgccggaaggtagaaattcatcgtcattcttggttggattatcccttgtgtcgaaaaagttctccacattataggtcatgactttgaacgtagcttgggcaaataacggaggggaggcaaagaataaaagaaaaaacataaaaatcttcatagttaaagctttgattaattgttaatatgtaatgtattcttattcgtttgaatcttcggtctcttcctgaacaaactcgtaggctcctatggtcgggccgttcgaactggttagccggttgacaccgtaacgatcgatcggataattcttcgttatctcgggatctgcttttccgactccggtagtcgatacggaatctggccggaaatcataggtgtatttattttgcttgcctcctactttccgataggaaggagtctttttgataaacaagacctccttgaagtgatcgctggaggattctttggctttaagcgcacagtgattgaaccgataatcgaaatctgtactgccatctgcttttaattcgacatcgtaacttccatcgatagtgcaattgtcaaaataagcttgcgtgataggatacgggccatttccgtctactgttacgttattgagcaagtacaggcatttactatccaaaggaacagtctcgctggccatttcccttttggttaaactcatgtaattagccatcgtacagtgagcgaagtaatatttaccaccgactaaagtgagtacacttcctccggcattgctgaattccgtatttgtagcgataacatcacaattgatggcgaagaatagatcgctccccatattcgtgatctgtgagttgtttatcttgatctttggccggtccggggtggaaggctcgcaatatacaccggaggtaccattacgtacgattacattatcccagacattcccgtagctatccgccttaaaggtaatgcctccccattgtccgggagtccggtcatacggtaatatatcatttagtatataatccaaacggtcgcctcggaaagtgataggctcatccaaggtgcctaaagcgttcatggagccgtgaacgatcaggctcgctttatcatgcatatagaaagtagcccccttctcgatattcaatgaaacccctttagcgataaccaaactatcgtagatcaaataaggacgattggccgtgaggatagaatcttttgtaatcgtaacaccgcctttgtaaagattaacatcctgcccataggcttccaataatacggattgacggatgccattcacggtgaaaagtacggaatcctgtatcaacagaggttgattgcccccattcggatcgaccgttacttccacgaatacatacatgctgtcgttggcgagtattcctacattattaaatgagctacctttgcgtccatccacattcatgcggaagccggtagactctccactggccagcatgatggactcaatgctcagaggttcactatttttattgtagatcataaattgacgggtggtagaaccgatcgtactgaagatcgtgtcaaaagcgagcgtgtctgtcgagaagcttagccggtaagtcgggttagtggaataatgatcatccaaaccgtcgcatgccggaagcatgttcaacagaagcgtcgcgagtataaatagcgttatcgttaatcttttcattttcgtaaatgttaactgtaaatatcttgtgttcttgtttcaatagataaacaaaattatcataaaaaagttgcaagacattaacataaaaaaagaggatagacacggttatcgtgtctttcctctttttataacgcaaaaaacgttggtttattttgcggggatgctctttaataattcaagaaggtggctccaccataaaccgaccgtagcgatctcgatacgctcgttgggtgaatgtacgtcacgcaaagtaggcccgaaagagatcatatccagtttcggatatttttccaagaacaaaccgcactctaatccggcgtggatggccatgatcttggcgtctttgttgaataggcgtttgtaagtctcctgtgcaatcttcaagatcttagagtcggggttcggggcccatcccggatagccgtcgccatgttttacatctgctccagccaataggaacgtggaggctaccgtattggcgatagcgatcttgcatgattcgatagagctacgctggctggtaccgatcaagatcgtattgccttctttcatctttatggaagcaaggttggtagaagtctctaccaagccttctatatcgtggctcataccgattacgccgtgcggacaagcgtgtaaggcgtagattaatttctcggcggtggcattgtctatatggtactccggacgatccgtggactccatcgctaactgaacgttcggatctacatgtttcaactcattttcaacgtcggcggcgaaatggttcagcaagatacgtacatcctccttattttccggatgcaagccgattacggcgtgtgcctcgcgagcgattgcgttacgtaagtttcctccatcgatagagcaaagaacgaaatcatatttctttttcaataagaataagaaacgaaccaagatcttgttggcattgcctaatcctttgtggatctcgccaccggagtgaccgccattcagccctttcacgtcgatacggaaatactgcatcttatcggacgtaggaactggctcgtaatggaaagtcgcttgtgtgtctttacctccggcgcaacccataaagatctctccctcgtcctcgctatcgagatttaacaagatatctccggtcatgaaaccttctttcaaggctttcgctccagtcaaacctgtttcttcgtctaccgtgaacaaacattcgatcggaccgtgttggatatcatcggaggcaagcaaagccaactcggccgctacaccgataccattatcggctcccaaagtagtgccgttggcacgcagccattcgccgtcgacgatcgtctcgatcggatcattgtcgaaatcgtgtttcgtaccgttatttttctcgcaaaccatatccatgtgagactgcaatacgactaccggacgatcctccattcccggagtggcaggctttgacattaaaaggttgccggcttcatctttcttgatagctattttgtactctttcgcgaatgattctaggaattcaatcattttgccttccttttttgaggggcgaggcacttgggttacttgatggaagaacttccatacgatagtaggctttaaatcagtaatcttcataatgttacaatgtattatagatgttactctaaagttaataaaaccgcaactgaaagagcttagttcgaaaaaaagtagaataaaatgccaaaaagacacttagtaatcacttaaactcttatatttgcgtccacaaatatagagaaaatgcttacaacgttattatttacggtcataattcttgttatcagcgtcgtgttgctatcgataaaagtgctgttgaaaaagggaggaaggttcccgaatacgcatatcgaaggaaacagggcgttgggtaagaaaggtatattttgtgcgaagaccatggatcgtatggcggtgaagcaaaagggactctatgacatcatgaacgaaataaaagaataaaaaaataagatttaaattgcactttatgaagaacattaactacgttattaacggtgtgctagcggtggctgtcgtaatcttgtatattatgcaattttccggcaagaaagaatcaagcgtaacaagaacattcgcgtcagcgggagacacaacggccttacttccgatcgcttatgtaaatgtggattccctgttacttaattacaattattccaaggatctgaacgagatcatcttgaagaaacaagagaattcccgtgctaacatcacccagaaagcccgtagtttacaaggcgagatgcaagatttccagcgtaaggtagaaaataacgctttccttacccgtgagagggcggagcaagagcaacaacgtttattgaataagcaacaagagttgcagaacttagataaccaattggctcaagagttgatgcaagagcagcagaagttgaacgagcaattacgcgatacggttgtttctcaattgaaggctttcaatctgggtagaggctatcaagtggtattcagcaatacggtaggagataatatccttttggctggcgattcctatgatatcacaggcgaattgctggaatacttgaataagaattattcctctccggccaagtaagctattaatagaatttataaaagaaagggtgtatcaaaggaacgtttgatacaccctttttttaacggtgcttaccggggactttatagaagatatactgtatctgcaaagtaatatatactgcgttggcctggtcagtatatattcatcggtcgggtcagtagcactgcgttttgcggccaattactctttaggagtaacgaaagcggtatatatctgtaagatagcggctacgctcaagcaaaggatccactcggtacggttgttgaacataaagccggaagatacgatcattagaagtccggcgaatacgttgaaacggtggagccggcggcgacgaaagtccaagtccttaaccggaagggtcagatagcaaacggctatacccgccgcaccgacagcgaataaataaggggcgacagcccaatgagtaagaaacaatatggcaccggctaatacgagtaatcccgctacgccgaaaataatcgatctgatttgttgattcatttatttgtccttgataataaaaacatcctcgttcgaccttttcatgaaatactcttcacgggcgaaacgttccagtccctccttgtccgtatgaaggtcgtttaatttcttgctgttgatctcgatctccttttggtaatgtttgatctctttctccaaaccgcgtattttctcgtcgtacgtatagcgtttatacaggctgctatcgcccaccgtaaaggtgacgataaggaacacgatggtaaccaaccaataagcgttgatccacgatagatactttatgtaaaactcttttatgcgtgacatcagaacatcgttttcgcgaagataatgaattattttgtttatctttgtcttatcaataaaaagcagagaatggataattatattgtatcggcaagaaaatatcgcccgtccactttccggagtgtagtagggcagaagtctcttaccactacgctgaaaaacgcgatacaaagtaacaaattagcgcatgcttacctgttttgcggtcctcgtggagtaggaaagacctcgtgtgcccgtatctttgcgaagacgatcaattgcttgaatccgacggcggatggcgaggcttgcaatgcgtgcgagtcgtgccgggctttcaatgagcagcgttcttacaatatccatgaactggatgccgcctcgaataactcggtggacgatatccgtaccttgatcgaccaagtgcgtatcccgcctccaatcggtaaatacaaagtcttcattattgacgaggtccatatgttgacaaccgccgctttcaacgcattcttgaagacattggaggaacctccgcatcatgctctctttatcttggctacgaccgagaagcacaaggtgcttcccacgatcctttcccgttgtcagatctatgatttctcccgtatatccatcgccgacatggtggagcatttgcaatatgtctcttcgcaagagggggtaacagcggaaccggaagccttgaacgtgatcgctcagaaggcggatggaggtatgcgcgacgctttgtctatctttgaccaagtggtaagtttcacgaatggcaatatcacgtatcaagcggttatcgataacttgaacgtgctggattatgagtattattttcgtctgacagatgcgatcttatccggcaatgtgcgggcttctttattgatcttgaatgagatattaggcaaaggattcgacgggcagaatatcataaccggtttggctgggcatttccgggacttattggtatgccgggatgagtccaccttggtgctattcgaggtgggtgcttctatacgtgaacgatataaggagatggcgaaacattgtccggatcaacttctgttcaaggcgatagagctggcgaatacgtgcgatttgaattatcgtgccagccgcaataagcgtcttttattggaattgacgttgattcagctctgtcaattaacacaggtagccgccgacgataaaaaaaaagcgttaattgagccgattgctgggacgaatccgtcttctcaagcggtgaatagcgggaagcctcaacagccgcctcaagctccttcagttacggcagcggccggtgctccacaagttatgagtacgcacatgccgagctcggttcctgcgccacctccgtctacagcgcctaattcggttcgtagaacggctcgtccgatgggaatctccatgaaggagatcggagtggagaagcctaagcaacaaaccgttcaacaagcgacaacgaacgtaaaggaggtagtaactccctttgacaatgattccttggttcgtgaatgggataattacgccgcaacgattgacaagaaagtgtatcttaagaatacgatgatcaattgcaagcctaccttgcaagagaattattatttcgaggtagccgtacataacccggggcagcaagaggaattgatcaataatgcgatccatatcctgccatttctccgccagcatcttactaatagccgtatccagatgcgtgtccggatcgtagagggaaatgagaagcatttggcttatacatccacggagaagctagagttgctgatgaagataaatcctaccttgggtcgtttgagggatgaatttaatttgacgttagattaagtagatatgctaaagatcccaagaagggatctttagtcttattttttattcctttgtctcaagataaaccacttgagtttgcaaatactcctcaagtccatgttttccatccgcgccaccgattccggatttacgccatcctgcatggaagccttgcatagcctcaaaattctcacggttaatataagtctccccgaattttaaggaacgcattaccttgaatgcgttatccaagttttgtgtatatacggaagatgtcaatccatattcgcaatcattcgcccatgcgatagcgtcgttgatatctgaatattcgacaaccggcagtatggggccaaaagtctcttcttgtatgatatccattttctgtgtaacacaatccaaaacggtcggttcgaagaaatatccttttgtaccgatcctatggccaccacacagtagcctagcaccttgttggatcgctctctctacttttttctccatagactccaacgcgctggcttcaataagcggtcccatatccagatccgcgacctcattgggatttcctacttttacctgcttcatgccggcgactagtttttccatgaaggtctcttttatcgctttgtctacataaacccgttcggcacaattacatacctgtccggtattgatcacacgagaggcaataatagacttaacagcaagatcgatatctgcgtccttcatcacgatagccggggctttacctcctaactccagagaaactttcgtgatattaggagcggcagctgccatggtttgttgtccggctctcacgcttcctgtcagactaaccatacctactttcggattcgccgcgagttcatgcccaatcacgctaccccgtccatttaccagattgaaaacgccggcaggcaaacctgcctcctccacgatctgtgcgaatacgtatgcgttctctggcgtaagctggctaggttttatcacgatcgtatttccggtgatcaaggccggagcggctttacgagcgactagaaagaatgggaaattccaaggtaggatacctgtcgttactccaatcggtctcttaaataagaaaatgttttcatgagggcggtcactgggaatgatttccccttcgtaccgacgggcccagcctgccatgtaatccatataatctgcggtaaaaagaacttcaacattggcgagtccttgggttttgcctccttcacggacgatgatgtcggtcagttccttctctctcttacggatgcctgccgctatctttgtcagataagccgccctttctatagagggtgttctttcccattgattctgcgctttctctgcggcatcgattgcttttctggcatcttcaaccgtcccgtcaggcatcagtgaaataacctcttcggtagaaggattcaataccttgatccatttcccagactcattctcaatgaatctgccatctataaacattttcaattctttcatgatactatttttaggttgaataatttgttcttaaaagtacgggaaaggaaggaatggcaatgttttaaaaatgataatagttctatcagaaatgatagtgaatcaagataatagggtagatataggaaaaacagcctcaagaagttgatcttctcaaggctgtttttttatagaatgatcgtttttcgttttagcaggctttgaagctcatgtccaagctcttcacggagtgagtcaaagcccctacggagatgaagtctacgccacattctgcgtaatcacgtaatgtgtcgaacgtgataccgccggaagactctacctcaaaacgtccgttgatgcggcgaaccgcttcttttgtattctcgatattgaaattatccaacatgatacgatcgataccgcctactttcatggcttgttccaactcgtcgaagttacgaacctcgatctcgatctttaggctctttcctttctctttcagatagttttgcgcacgtgtgatcgcttgctcgatgccgccggcgaaatccacatgattatctttcaataagatcatatcgaacaaaccgatgcgatggttcatgccgccaccgatacgtacggcctctttctcgatcatacgcataccgggagttgtcttgcgagtatctagaacgtgtgtcttggtgccttctaacgccttggcgtatttacgagtcgtagtagcgataccgctcatgcgttgcataacgttcagcatcaaccgctcggtctgcaataaggattggatcttaccttccaccacgaacgctatatccccttttttcacttcggctccgtcttgtataaagaccgtcattttcagttccggatcgaagtcgtggaagatacgtttagccatttccacgccggccaatacgccatcttccttgatgatcagctggcttttccccatcgctgtctcggggatgcaacataaggtggtatgatcgccatcgccaatatcctcggcaaacgctaatttgattaagtcgtcaataagtttgtccatcttttattctattctgattgattgtatgatcgctgtattcccttcggcacggtacgtgatgtttacacggtactcaccggaagacgtcggaagctttccgacaaggaaaccgctttcctttttatccgcatgatgtacgaccgagaatccggaaggcttattcgaactgaaaaatgaggacaacatagagacggcctcacttccgttacatttcttagaggaactgggcaaggctacatccaccaccttatccatagcaccggatagagaggaggcatttcctgccttgaaagcatttgatatactggtaatatccgccgcctgcgcacatacgaacgcgaatatcaaggcgaatgtaagtaagagtcgtttcataagctttctttattttattgagtaattagtggcaaaggtatgtatttttcttgtaacttagcctttctaaacatgtaaatgtaagtagatgaagattggactgattgtgattggtaagacggatgccggttattttgtggaggctatcaatgagtataaaaatcgcttgacacattatataccctttgaaatggaagtcataccggatataaagaacgtgaagaatctctctgaggcgcagcaaaaggagaaggagggagaattgattttaaaggccttgcagcccggcgattatttggtgttgctggatgagaaagggaaggagtttacctccatgcaattttctacttatctggaaaagaaaatgcatacggtcccgaaacgcttggtatttgtggtaggcggtccttacggttttagtgaagctgtgtataaggcggcatcggaaaagatctcgttgagcaagatgactttttcccaccagatgatccgactgatctttatcgagcagatttaccgggcaatgacgatcttgaataacgagccttatcatcacgagtagttgcgtcggttaacggcagtataggcgtagccctatacctatactgccgtaagctcacgcctatactggcgtagccttacggcaatactggtgtttttttacccggattaatggactaatttcaacccgacgatccctatcaatatcaaagataagaacaataacctgaatatatttgcggaatcatggaaaaacaagattccaagaagaacagtccctatagccccgatcccggtccagattacataagccgtaccgattgggatgcttttctgggcgagatataagaaatagccgcttaagcccatggataagatcgataaacctataaaccaaataaaatatttggaatgcatacttgctaatttaaagcccagcggccagccgatctcgaataatccggctataattaacagaatccaagccatatagaattagtcttaaaagttttcccgtgtcttttggatcaataaataatccaataaagtcatggcggtcatagactcgacgataggtaccgcacgaggcaatacgcatggatcatgacgtccgcgtgcctttaatatcgtatcctctccctccatattaaccgtttcttgttccatcaagatcgtagcgaccgatttaaaggctacccggaaataaatatcttgtccgttggatatccctccttggataccgccggaattattggtacgagtattgatatgcccgttatcattgaaaaagcgatcgttcctttccgatccgcggaagaaggcggcgttgaatccgtctccatactcgaagcctttcacggcgttgatcgtaagcatcgcatgtcccaacgcggcatgtaacttgccgaacacaggctctcccaatccgacgggaacccctttcgccacacaggtaataacaccgccgatcgtatctccttttgatttgacctcagcgatcaaggtttccatctctgaggcggtcttcgggtccgggcaacgtacatcgctcttttccgtcaagcttaaatcataatcttggtaactacccgctaatttgatcgggccgacctgcgaggtataagcttgaatctgtatgccgtattgcttaagggcgagtttagcgatagccccagccacgcaacgagcgatcgtttcccgggcggacgaacgtccacctccacggggatcacggattccatatttcgtttgataggtataatcagcatgggaaggacggtaaaccgttttcatattgtcatagtcagaggaatgttggtttttgttccagatgatgaaacctatcggcgtaccggttgtctttccctcgtagataccagaaagaaactgtacctcatcatcctctttacggggggtcgtgatacgggattgtcccggtttacgacggttcagctcttgctggatgaatgccgtatctaattcgatcccggctgggcatccgtcgatcacgccgccgataccggggccgtgcgattcgccgaacgatgttaatctataaatattaccaaaagtattcaccgttttgtctaattgaaaattgaaaactgaaaattgagaatcaaaagccgatgattaggcacttctccta
